United States Patent 12,790,634 (MOST PROBABLE NUMBER ANALYSIS OF HETEROGENOUS POPULATIONS) - sequence listing, part 16

SEQ ID NO: 9 - DNA, 3519368 bp, unidentified (residues 1-1,759,684 of 3,519,368)
  source 1..3519368: mol_type = genomic DNA; note = Anaerostipes hominis
aataagacaaccttgaaaattctaagagattttcagtatctttaaaaaagatacacgaacgttctttataaaaggacacagtaaaacaaggataaaaaagctagcgctttttagatccaagattgaacatgagagtttgatcctggctcaggatgaacgctggcggcgtgcttaacacatgcaagtcgaacgaagcattttggaaggaagttttcggatggaattccttaatgactgagtggcggacgggtgagtaacgcgtggggaacctgccctatacagggggataacagctggaaacggctgctaataccgcataagcgcacagaatcgcatgattcggtgtgaaaagctccggcagtataggatggtcccgcgtctgattagctggttggcggggtaacggcccaccaaggcgacgatcagtagccggcttgagagagtggacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatctaactgaccggttcgtaatgggacctttccttcgggacagttaagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccttataggagggagctgccgaaggtgggaccgataactggggtgaagtcgtaacaaggtagccgtatcggaaggtgcggctggatcacctcctttctaaggaagaagaagtaggggttgtcttattgtttagttatcaatgataacaaaaagtatcaagcaaggaagttctattgcactaaattcgctgcgccataactggctggctcattaagttgcaaagaacaactttcgtactaagctcgaaagtacctcgctaagtactcaatgcttccggtggcgatgcgttttggggacacacccgtacccatcccgaacacgatggttaagaccaaaacggccgatgatacttggttggagacgacctgggaaagcaggtggctgccggatattttttactcaacgaatcgaagatgagtttagtaaaaaaatcgttcgcgatactcagcgaaagcaacgcttgagcgctagtagagtcgaacaaacccgagggggattagctcagttgggagagcgcctgccttgcaagcaggaggtcacgagttcgaatctcgtattctccacgcagacaatgaagattgtctacaattaaatggtgggccggaaggaacggccatatccaaatgggcttgtagctcaggtggttagagcgcacgcctgataagcgtgaggtcggtggttcgagtccactcaagcccagcagcgtaacattggattgacagtggtactgaaagcatctcagagacttcgtctcttcgatcgcggcagagccgctaatacaagcaaaaagtaattctgcttaggaatgtaaacattccacacagaattccgttttccttgtgctttcaatcctgcatacgcggatgtaccttgaaaacttcatacagaacacaaaaagttattttttataagaaatgacaagacatcaaacaaaacgaattacccgttgtcatcacgctagatgacaatgaggatgatagaacaactatcgtccgttctatggttaaagtagaaagagcgtagggtggatgccttggcactaagagccgatgaaagacgtgataagctgcgataagctgcggggaggagcaaatatcctttgatccgcagatctctgaatggggaaacccggcggagtatccctccgtcagcgtatggtgaatccatagccatacgtggggaacccggggaactgaaacatctaagtacccggaggaagagaaagaaacctcgatttccaaagtagcggcgagcgaaatggaaagagcccaaaccagaatgcgtgcattctggggttcggactgcaacatgggattatgtatgacaggagaacggcctgggaaggccggccagagagggtgaaagccccgtatccgaagtcagaagtaccctggcaggatccagagtaccacgagacacgagaaaccttgtgggaatgagcggggaccaccccgtaaggctaaatactccttagtgaccgatagcgcatagtactgtgaaggaaaggtgaaaaggaccccgggaggggagtgaaagagaacctgaaaccctatgtttacaagctgtggaacccctttagatggggaactgcgtactttttgtagaacggtccggcgagttgcccgtactggcaaggttaaggacttaaggtctggagccgaagtgaaagcaagcgttaagagcgcggtagatgatcacactttgtgtggtcataacagtcagtgagggcagacccgaaaccgggtgacctatccatgtccaggttgaagcttccgtaagaggaagtggaggaccgaacccacatccgttgaaaagggtggggatgaggtgtggatagcggagaaattccaatcgaacccggagatagctggttctcctcgaaatagctttagggctagcctcatcaaagtctgctggaggtagagcactgaattgtctagggggcgtcaaagcttaccaaaacatatcaaactccgaatgccagtcagatgattgatgggagtcagactgtacgagataagttggacagtcgaaagggaaagagcccagaccaccagctaaggtcccaaagtacgtgttaagtggaaaaggatgtgggatttcaaagacaactaggacgttggcttagaagcagccatacattgaaagagtgcgtaatagctcactagtcgagagatcctgcgccgaaaatgtccggggctaaaacacgacaccgaagctgtggaatgtagaaatacattggtagaggagcattgtaagcgggatgaagccataccgaaaggagtggtggactgcttagaagagagaatgccggaatgagtagcgagaggaaggtgagaatccttccggccgaatatctaaggtttccagagtaaagctgatctgctctgggtaagtcgggacctaaggcgagggcgagagccgtagtcgatggataactggttgagattccagtaccacataaaaacagaactgtggggacacagaagggaaatgggagccaggaatggaaagactggtgcaagcgaagtagccgtatgggaggcaaatcccccatgcaaggcaaaggcgttacgcggaccgaacaaaagtagggaagcccaggcccccagctgtcaagaaaagccgctattgttttttatgtgcccgtaccgtaaaccgacacaggtggatgaggagagaatcctaaggccgacgggagaagtgttgttaaggaactcggcaaaatgactccgtaacttcgggagaaggagtgccaggtaagactggccgcagagaattggcccaagcaactgtttagcaaaaacacaggtctatgcaaaaccgcaaggtgaagtatatgggctgacgcctgcccggtgctggaaggttaaggggagggcttagcgagtgatcgcgaaggtctgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacctgcgccaggacggaaagaccccatggagctttactccagcttgatactgggattcggtactgcatgtacaggataggtgggagactgagaaagaaggacgccagtccttttggagtcactgttgggataccacccttgcagtattggatttctaaccaacagccatgatctggttgggggacaatgtcaggtggggagtttgactggggcggtcgcctccgaaagggtatcggaggcgctcaaaggtcttctcagaatggacggaaaccattcgcagagtgcaaaggcagaagaaggcttgactgtgacaccgacgggtggagcaggtacgaaagtaggacttagtgatccggtggtataacgtgggattgccatcgctcaacggataaaagctaccctggggataacaggcttatcactcccaagagttcacatcgacggagtggtttggcacctcgatgtcggctcatcgcatcctggagctgtagcaggttccaagggttgggctgttcgcccattaaagcggtacgcgagctgggttcagaacgtcgtgagacagttcggtccctatccggcgcaggcggaggaaatttgataggagctgtccttagtacgagaggaccgggatggacggaccactggtggatctgttgtattaccaaatgcatagcagagtagccaagtctggaagggataaacgctgaaggcatctaagcgtgaagcccccctaaagataagatttcccatagagtaatctagtaagaccccttgaagacgacgaggtagatagggcagaggtggaagtacggcaacgtatggagctgactgttactaatcggtcgaggctttaaccaagagaaggtaaggaagatgtttgatgaaaggttctgtatgtagttttgaaggtacatcagaggaataatcgaaggaaaaaagagaaagaataaaaagaaatgatcctcgatagctcagttggtagagcgcacggctgttaaccgtgttgtcgctggttcgagcccagctcggggaggtcaaaaagaccgtgaagcggtcaaagaaacaaggctccatggtcaagtggttaagacaccgccctttcacggcggtaacacgggttcaaatcccgttggagtcattttttcgtatcataaattagatacgtttgcatatactatattatatggcgccatagccaagtggtaaggcatgggactgcaactccctgatcaccagttcaaatctggttggcgcctttttactttaataacgcggggtggagcagtctggtagctcgtcgggctcataacccgaaggtcgttggttcaaatccggcccccgcaactctaagacagtctggatatcgaaagatatccggcttttttatattttaaggcatctgggcacgaaaagttgtcaagcatttcaaaaagtgaggggttggggagaagaggtgggctttctaactttgtactttatttaaaggagggattatgaatcataagaacaagatggagacccgaccgatgtttccgttgatcgtatccatggcagtacctccgctcatatccatgtttatgcagtatacatataattttgtagactgtatgtttgtctcatggattggagaaaaggaactgactgccgtgtctctggcatttccaatcacaaccctgatgattgcgatgtccatatggatcggtgtcggcgttaatgtactaatcgcagataatcttgggcaaaagaatcaggacagggcaaatagtgttgtcacaaatggtatattgctttcagctgttatgggaatcatcgttaccggtgctgtgcttgtgataacaaaaccttttttttcatcttttacagacgatccggaaatatatcatttagctgtccgctacatgagaatctgtgcttttttggaagtatccagtatggtacatatttgtattcaaaagattcttcagggaacagggaatatgatcggtcccatgtggtttcagatcgcgggagttgtcctgaactttatacttgacccgattcttatatttggctatttcaattttcctaaaatgggcatcgaaggggccgctgtgtcaactgtatgcgggtatacgctttccatgattttagcctttattgtacttattttccgaaagcaaaaggtcaggctaaaaataagaggttttcatattgatttccagatgataaaagaaatttttgtgatcggatttccatcctttatcatgaatgccctgggagcatttatgatttactttacaaatatatttcttgttgtatattccacgactggggtagcatttttcggggcatattttaaattgcagcaagttgtcattatgactttaaatggtcttgtacaaggatgtattccgattatgagttataactatggtgcaaaaaatatgccaaggcttcgtcaggcatttaaatatggaacaggaataggaattggccttacaggcatcagcattattctgttttggacatttccggaacagattttaaggattttcaatgcatccgatgaaatgatgacatttggagtgcccgcattaaaaattatgtgtacaagttatgtatttgccgcggcggccacaatggctgcatcgtttatgcagtcaaccaggagagttggattcagtctgatcattaatatactgaggcagctgatacttctgctgccatttatgtggattctttcatattttattggtatgaaaggaatctggtggtcttttttagctgcggaaacgataactgtattcataagtatctgtttatatagaagatatccggtagaattttcgaatgaccctgtgtagagcaggaaaaaatatgaattacagaacgttttattcttgcagaattccattcaagcaagtataatcaaaaaagaaaaaaaacagacaggagaaaaaatatgagtatacgtataggtattttaggttatggaaatctcggacgcggagtggaatgtgcagtccgtcagaatccggatatggaacttgctgcagtttttacaagaaggaacccacaagatgtaacgattcttacagagtcggcggtagtgtgcaatgtggcggatgcggcagactggaaggataaaatagatgtaatgatcctgtgcggcggaagcgccacagaccttcctgtacagacgccggaatatgcctctatattcaatgttgtggacagttttgatacacatgcaagaattccggagcatttcgctaatgttgataaagctgcgaaagaaggaggaaacgtaggcattatttccgtgggatgggacccaggaatgttttctttaaacagaatgtatgctaatgcgatccttccagacggaaaggactatacattttggggcagaggagtaagtcagggccattcggatgcaatccgccggatagatggagtaaaagacggaaagcagtatacaattcccgtagatacagcactggaagcagtaagaaacggagaggaccctgaacttacaacccgtgagaaacatacgagagaatgttttgtcgtgctggaagaaggggcagatgcgtcaatgatagagtcagagatcaaaaatatgccgaattattttgcagactacgatacaaccgtgcattttataagtgaagaagaattaaaaagagatcacagcagcattcctcacggaggattcgttttgagaagcggaaagaccggatgggaaaacgaaaataagcatctgattgaatatagtttgaagctggattctaatcctgagtttacatccagtgttattgcggcatatgcaagggccgcttacagacttgccaaagaaggacagacaggatgcaaaactgtatttgatattgcgcctgcatacctcagtgcgaaaacaggagaagaactgcgcaaagaattattataataagataaataaaaaaactccggagcaaaacatgaactccggagtttttttgtaacgttttttagaaatcaagcatagtctttccttcaccgcagcagttttcaaagtcgcggatgaagtcttttacggcaccttcagcaacctggttgaatgcgagggttttcaaggtatccggattgactgtgacagatccgataccgaatttgcccatttcaagaacctgctgagagtttttgaaagatgcaccgaggacttccgcatcatatcctgcagccctgaccatggtatgaatatcttttgaaatctgcacaccattgtatcctaagttatccaggcggtttacataaggggcgaggaacttagctcctgctttcgcagccatgaatgcaggcattacaccgtaaatagcggttgcggttacgttaattccctctttgctcaggatagaaatcgcttttaatccgtttgcagttacgggtactttaatgtacatgttgccgccgatggcatcaaccatatgttttgcttcttttaccatatcatcggtctctgttgaaagcacctgtgcatgaagcatcgcttcttccgggatcagagcacggatcttctttaactggtccataggatcaggatttccggtcttgcccaagatcgtgggattggtagtgactccatcataaggatatattgcatagagttcctcgatttttgttaagtctgcgtcgtcaattaaaattaacataatatatctcctttttgtaatttatagctggcttaaatgattgaattaaacggtcaagtctccgatgatgtccaggatttcttcttttgtctgtgcttcttttaaatttttgatattttcttcttcacagattacttcagagagcttcataaggatatccaggtgggttccgtctttgcctgcaacacccataacgatatatacggtgtcatcgccgtatttcaccccttccggtacctgaataaaggatataccggattcttttatgtatttttcggaaccgtcgataccatgagggatggctacgttattgccgatgtaggtagagatgacttcttctctcttgtgcatacattctacatattttggatccacatagccctgttccaccagaactttacccgccacgtcaatagcgtcttccttattccggaggcgtttgtttaaaacaatgttgtctgcgttgaaaatcttattcatgatgttctccttttttattgaggtgtttgatgcgttttctggtttcttccttgtccctgtcgttgagcagcggggatacacagatgtacttatcgtcgcctaaatccagcggtactgtggaaataatcaggtcatagcgagacaggtcttcatcggagagtttatggagagaaataatcttctctacgtcgatctctgcaaattcccgctccagacggcttcttaacatcttggatgaacccatgcctgaggcacagacgaccaggacttcaatggactgtttggtcagatactccatcgatgcaataaagtagatgacgatataccctatttcatcatccggcaccggtacggaggtgtgtttaaaaacttctataaaactctgcctcacaatatcataaagctttggatgggactgataaatatcgtcattgagaggattggatacattcatgccgcttctgatccgttccagggccatattgatgtgaagcataagattctcggcaaggttctcatcttcgctgtatgggaaaccaaaccgttcctctactctggcgatcagctgggtgaccagatccagctgttttaaaatgctggaatcatttgcaacatggtagtgagtgcgtcctgtatataggttgatcatccagttgaagtagttaagctctgtatcatagagcttaatatgaaacttatgttccagcaggtgtttgatacttttgtaaagttccagctcaggatttggtatatccacggagagccttaactcgtcctccttttcatctacaagagaatgccttttgataaaaatacacaggaggaacaaaaactcctggaattctttatcggatacattgagtctcttttttgaaataagtggattcagaaaatcatagatgacagataatgtgtcttcataatcccattgaatcaggagattgatgaatgcacagcttttgtattttttgtttttcatccagtcaaagaaattatccagaggaatatttctcagaattatgctgatcaacaggtgacgttttgatatttctttcccttctagtataacaccttcacttcgttttgtaatcaaggtaatatcatcattttcaaggaaattctgcagctggtgcagactgtttctgatcgtctgcgtagacgttttcagatcgatggccagtgactgagtctttacataatcattctcgtggagaaggatgagaagtatcagatcattccgttcttttgcggtataagtctgttccaccttggactcctcaaagagatactccagccgtttcatattatacagggaaccatagatctgcattcccctgccggactgagattccagctttaaatcacaggattccatgatgtcatttatttcgggcatttcgcggtaaacggtacgttctgtgacgcccagttcctttgcaatctctgaaaccctcacataaccggttgcatccagcagatattcgataatttcttttgcgcggtcagaaataaccatatcttcacctatcttcctctctgataaaatcgatcattgaatttaaacaacgagccctctgatttcattgtattgtctgtcaatcatttttaaaatggatgcaaaatctttgggtgaatttttcaactgttcataaaatgccataatatagttgccgcagggttcatcggatgatatttggcatgtctcgtttaaaagctcgtgagcggaagcatccgctatactatatagggcagctgctgtggaaaaagacagataaacagggagaacgccttcctgttcgcagccgcgcagtgctcctaccaaacggtccttcggctttaactttctgatcggttcccttcctacacgttccacggtatcgtggagataagggttttggaagcggaacagcagattgtctatatgagctttcagctcagaaaattctacatgatacctttttgagatcatcatggcactttctatcatagcaccttccaccagctttcgtatatagatatcaccaatactttcgtcaatatatgtatatccttttatttttccaagaaatgcagtaacagcatgggccatgttatggatgtacagctttcgttccagataaaaagaaaacgggctgaaaggcactatttttttatagtcaggaattggccctttaaaggcagcccggtcaaccggaagataatcataatcttccacacagatccggagcggatcaccttttttcatagcttctgtcatcacaggcaccatgcggccaatggaagtttctacaagtccaaggctttcatccaaggtttttttatgtctggcgggcagcatgtctttgattttttcatataaaaattcatcggcatccattaaattttcgcagatcagaagatccagtgtgttggcgggatctttgtcccagcgtctggtgagtccctcacagatgaccggaatgattttttcgaggacagtgacacccacggaagtagccagaaggtttgcagatgctatttcatcactgacagcggaagcatcttttccgtcaacggcccgtatgttttgaatccagacagttttcccgttttttcccacaatctcctggggataggttttatctctgttaatggcatttataacgtcgtcatttacatcgacaaatacgacttcatagccggtctgtgagagcagggcaccgataaatccccgtccgatattgcctgccccatacataactgctttcatttgaattccctcccaaaataccggaacagggcattccccagaaggaaacgcccgttccaattgctatgcttattattcggattgtaccaagagtactcagtttaacggttttttaaacgttctacaagttcatcgtattccggagcctgaagatagttggtaatggataagtgctgctttttaggctgagctgcttttgcagtacctgtcagctctttgtgtgtgatcactaaatctgtgtcatccggaatcttggagatcgcagtgttgatgacttcaacagggaggtcagccgcttttacttttttctttaatgctgcagcagacattgcactggagcccatacccgcatcacaggcaacgacaatcttatttacatttgtaagatctaagcctgcaacaccgagagaagaatcgtttgtcacggcatcagatgtattggaagtactggagcccatggcttcttttggaatgacagaaggacctaaagaagcttctccctttccttttgccaccattcgttttacaaagaaggcgttgatcacaaaagataccgcacaggagattgccacacctgcgatgacaccgatcatagaactcttgggcgacagtgcaaggactgagaagatactgcccggagaaggtgttgcaacggttcccacattcataagcgtaaatgtaccggtacctgcgataccgccggcgatcataccgatgattgtgagaggattggctaatacatatgggaaataaacttcatggataccgccgaagaaatgaataagaatcattccgggagcggcttctttcatctcgccttttccgaagaaccagtaagcaagcaggagtccgagtccggttcccgggttaggaactaataaaaacagtgctgaatgtcctaaagttttaacctgctcgtaaccgatcggtccaaaaataccgtggtctaaagcgttatttaagaatagtacttttgcaggttctacaaaaattgcagacaaaggaagtacattgtgagttacaatccagtttactccgtttgtgagtacctgagtcacggtatccatgacagggccgaatacaaggtaagctacacagcagagaataccgccgatgatacctaaagagaagttgttgacgatcatttcaaaaccgccggggatttttccgtctacggcagcatcaaactttttaatgcaccatccggatgcaggtcctaagatcatggctgcgaggaacatcggggttcccggcactgctacgatggcaccgacagttaccaatgcaccaatgactcctccgcggtctcctccgaccatcttacctccggtgtgaccgatcaggataggaagcagtgaattaaggatcgggctgattaaatttgcaagctttgcatttggtgtccagcctgtttcaaggaagaatgcggtgatcaaaccgaatccaatgaatgcgccgatatttgggataaccattccggccagaaatgctccgaatttttgaagcttctgggagaatgttgttttttcatgttccatactataactctccttcttttagataattctcattgataatcctgatgaattcttcttttgatgcggcagataatagtttttcacattcctccggtttgcagaggatatcagtaatctgcataagttcctgtatggtgtcttcttctttacatgcaattcctatcacataggttacactttctccgttgtaatcaatggtgtcaggaaagtgtgcaatgcagattccggattttaatacctgatccagagaagtttcatacccatgaggtatggcaacgccgaaccctaaatatgtattatgctcaagttcacgttcgagcatgctgtcttcatatccgggattcacatatcggttggatacaagaagtctgcctgcaatgcggatcgcatctttctttgctgtacttggaagtccccatgcaatgttgtttaagaattcatcatcaagaagtttgccggccatgctcacctctcctttgttggacagcagccagttcccgggcggctgctgtttgctgtaaacgtttatctgtatttatcatagcttatgatttgtatggatgtaaatacagactaatgctatctttttcatcggaggttgtgacataattttgttttgaaacgatgacagaagaaaacattgtttgcgttgctaagaatacagtatacgaagagtgacttgtaaaaagatgttgaagagggtataatatcaaaaaatatattttttaaaatttacctaaactgttttttatagaataaaaatgtaaagtaaaagaaaaaacataaccatttattaaaatattagaccagtcaccaagaattaaaaatgtgtaatcagaatggaacagtaaaaaaatactataaacattcttaagcaattggatattatataattctaaaggagggacacaaattgggtatttcaattatgccggcaatgattctttcttgccttcttgtattagtaacaatagtggcaatcgtaaaaattattcagaatttaaaaaagtaagaattattagagatgataaaaaaacagggaatgtgtcaaaagcattccctgttttttgcctttcccgtggaatttcggacaatcagttccggttcatattccagcctcataatataatgatgctttgaaatcccgtctttttgtgtattcttcttataaataatatctacggcttccttccctttaaaagcggctgcgtgctcaatggttgtaagagagatctgaggcatcccggaaaggggaatgttatcaaatccgcagactgaaaagtctcccggtattttatagccgtgatcagtgatggcagacatgatcccgaacgcagtcatatcgttgttcccaacaaaagcagtggatttcgtgtgattctccaaggcctttgaaaccagatcataaccatttaagtattcggaattgtccggtgtatatctggaataagtagagaacttagaggaaagaacctcgatattattcaaatcaaggttgtatgccttaaaactgtttttcaacccttccaatctgtgaagccttccgatttctttttgtttgattggtgccgaaacaaaagatacatgggtgtgaccgagagagatcagatattcaccgagtatgaacccgggctttttgctgtccagttcaaccgaatcaaatcgggagccctcaggtttgtcaccgatggagaccataggcaccgacttggacagagcattgatctctgaaatcttagaagacggaggatacaaaaaaatgatgccgctcaggtcaaagtttgaaagcatctttatgtaatactcctcctgagacacatcccggatcgtggatacggaaaatacggtgtagtcatattccctggcgcgttctgtgatggaatggatcagcatggagtagtagccattagagagaatagggcagataacgatgattgttttagagagtgcggatgctttttttaacgcatttttctccggtttcttatagcccagttctttggctgcggcttttaccttatccaccgtctcctttgaaaaagaaacgtgaggcttgctgcttaaaatcatagaaacactggactgggagagtcctgtgtactcagcaatatcccttgttgtgactttatttctctttcccataatgagcctcctgtcaagtagaaatatcttcgatttattttgattaataaaaattactaattgaaactttttattgattattaatattatactaatgattaataacaaacacaaggaaaacaggggaaagtatctgatctgaaaaaaataaaaggagaaaaggcctgttaatcaatgttttatgattaatcaaaagtaggtgaaagccgcataaaatggcggtttcatacgtttgacagggccaaattattatgattagataagggcagtaagacaaacagggactcagtcgaaggaggataagaacagtgtatgatgtagcaattataggtgcggggattacaggatgttccatcgcatatgaattaggaaagtataatgtaaatgcagtggtcattgaaaaagaaaacgatgtggctgtcggcacaacaaaagcaaacagtgccatcatccatggaggatatgacccgataccgggatctctgatggcaaaatataatatcagaggaaatcagtacataaaagagctgtgtaaaaagctggacgttccatttaagcagatcggagccctgattgttgcctttgaagaaaaggaggaaaaaacattagaagagttaaaacagcgtggagagaaaaatggtgttccggatatggagatatgggatcaggaaaccttaagaaaagaagaaccgaatatttctgagaaagctatcaaagctttattttccccgaatgtaggaatcatcagtccgtgggaactggcaatcgctctcggagagatggctgccttaaatggtgttgaatttaagctgaacaccgaggtcacggacattaaaaagaacaatgattcttatgaaattaaaaccaacaacggaaccgttgaggcaaaatatatctgcaatgcggcaggagtcaacgccgacaaagtaaacgaatatacgaataaaaaatcctttaccatcaagccaaataaaggtgagtattacttattggataaaagccagggagaacttgtaaaccatgtgatcttccagtgcccgaataaatacggaaaaggtgtgctcgtatcgcctaccgtacacggaaatctgattgtcgggccgaattcacagccaacggacggagacgatgtgtcaacctcaacagacggattaagctttgtaagaaatactgccttaaaatccgtgcctggaattaacttcagagaatccatcagaaatttcgcgggagtccgtgcaagaacaaaagaggatgacttcttcatttttgaagatgaagaaaacaaaggcttctttaatatttcaggaatggcttctccgggactttcttccgcaccggcaatcgcagttgacctgttaaagatgatggaagagtcaggactttgtctggaagcaaaaaaagaaatcaaggacgagagaaaagtaaatcgttttaagaagctgagtgatgaagagagagctgcgctgattaaagaaaatccattgtacggaaaaattatctgccgctgtgagacagtgacggaaggggagattgtggacgcgatccaccgcccgatccctgccacatccattgatgcagtcaagagaagatgcaacgcaggcatgggaagatgccagggtggtttctgcggcccgagagtgcaggagatcatctcaagagaattaaacattccactggaagacgttccgcaggaccgtgtgggaatgaacattattacaggagaaacaaaaacaggaggtgccagataatgaaatatgatgtgatcgtagtcggaggaggaccagcaggccttgcggcagcagtggaagcgagcaaaaatggtgccgataaaatcttagtggtagaacgtgaccaggaattaggcggaatcttaaatcagtgtattcacaatggattcgggcttcattatttcaaagaagaattgaccggaccggagtatgcaaataaatttattgaaatgttagccaagacaaatattgaagtgatgctggacaccatggttttggatgtggatgaagagaaaaaatgcgttcatgccatgaacaagaaaaacggctatatggtactggaaggaaaagctctgatcttaaacatgggctgccgggagaggaccaggggagccattgcaatcccgggagaccgtccagccggagtcttcactgcgggtgcggctcagagatatgtcaacattgaaggctacatggtaggaaaaaaagtcctgatcttagggtccggagatatcggtctgatcatggcaaggcgtatgagtttagagggcgcaaaggttgtgggatgcgttgaactctgtccatattccaacggacttacaagaaacatcgtgcagtgtctggaagattacgatattcctctgtatttatcccacacgatcacggatatcaaaggggataagagagtggagcaggttaccgtacagaaagtggatgagaagaaccagccgattccgggaacagagatcatatttgacgtagacaccgttcttttatccgtaggcctgatccctgaaaatgaactgacaagggcagcaggaatcactatggacccgagaacaaacggaccggtcgtatttgaaaacatggagacatccgcagaaggcatctttgcaagcggcaatgttgtgcatgtccatgatctggtagactttgtaactgcggagagccagaaggcgggaagaagtgcagcagagtatgtaaagaacggagaggctgaagaccagacatatattgagctgaaaaacggagactgtgtaggatatacggtgccgcagaagatacgtcctgccaatgtggataagatggtggaagtgatgttccgtgtgcgcaacgtataccgcgatgtggcgatcaaggtgacttccggcggagaagagctggcttcctttaaacgggaacatatggctccgggggagatggaaaaaatcgtgataccaaaggcgtttttagataaggtgaaaaacggcgagatcactgtgtctgtagaaaaggtaggtgcttaacatgacagatttaatttgtattgtttgtccgaaaggatgtcacttaaaagtcgatgaagaaaacggatataaagtaaccgggaacggatgtccgagaggcgccgtatacggggaaaaagaattagtcaatcctaccagagtcatcacgtctaccgtaagggttgaggcagagacagcgagaagagtccctgtgaaaacaaacggagacattccgaaagggaagatttatgatatcatggatgagctgaccaaagtgacagccaaggccccggtgaatgtgggcgatgtgatcattaaagatgttcttggactgggagtagatattgtggcaacaaagaaagtaacagcataagcattataggaggaaaacatgagcgttattacatttatttgtgcaggacagatggcatcagcaattacatttccggcgatggaaaacggacacgaggtccgcttggttggttccccgctggatcgggacattattgacggattaaagaaagacaatttccatatcactttaaaaaggaccctgcacgacgggatcaaatattatcagattgaagaattagaagaggctctggacggagcagacgcagcgctctgcggtgtcagcagctttggcttagactggttctgtgatgagattcttccggtgattcctgataatgtaccgctcctctctgtgacaaaaggcatggtggatctggatgacggaaccctggttccatatccgatgatctttgaggaacgccagccggaaggaaagcatcttgacctcaatgccatcggcggtccgtgtaccagctatgaattggcagaccacgaccacagccatgtggctttctgtggaaagaacatggaaactctcaaaatgttcaaagagcttctggcaacagactactatcacatcactctttctaaggacgtagtaggtgtggagtgtgccgtggccatgaagaatgcatatgcacttggtgttactctggctgtcgggctttctgaaaaaatggaaggaaagatcggtatccagcactacaattcccaggctgcattgttcggacagagcgtaaaagaaatgacaagactcttagaactgatcggcggaggcccggaaaatattattcacggcgcaggggatctgtatgtgacggttttcggcggaagaacaaggaagatcggaacacttctcggacgcggattaagcttcgatgatgctatggaagaattacagggtgtgactctggaatccatcgtcattgcaacgagaactgcacgtgccgtaagaaaacttgcggaacgcggaatcgtttcactggatgagttcccacttctgatgcatgttgattctatcatcaatgaaagtgctgaggtcaatattccttgggaagactttacgatgattaaagaataaaaacaatcttatttattaaggggcaaagccatttttacggctttgccctttttgctacagctatataagaataaaacacttccaagtgtgtcaaatgacacaagaggcataacataattgacgaaacggtaaaatcaagttactgtaaagacagcagcaggaaaactcattggaaaggagtttgttatggagttgaaaacaacggtgaaggatttggggagaatggcgtggttttaccgggccaacagcagaacagggaaggtttttgggaaaaagagtctgcatctggatgaagagacagaaatggtaattgattatatgcattatccgaaaggatttacaacggtgcttcacagacatccaacttctcatggaatctatgtgctggaggggcagctggagacggacggtgaactttatgggcccgggacctttgtatggtatccggaaggaatcgcagctgcacatggagcgacagaatatgaagatctgaagtgtctgctgatctccaacaaagcattttccatcgaatatcttgaggagggagaacagagtcaaaattcccttgagaaaaaggtgacagatgtaaaccggatgccgtggttttaccggcagacgacaaccacagggaaaatatttggaaaaaaggctttattattggataatgagacaggtatgcagattaattatatgaattatcccgcgggatttacgactataaatcacagacatacggcaggccatggcttttttgttctggagggacagttacagaccggagatgagctttatggaccgggaacttttgtctggtatccggaaggatatgtgacggctcacggagcaaccgaatatgaagatttgaagtgtctgcagatatcgaataaaacttttaatattgaatatgtgtaaggctcagtgaaaggaacaggttatgggaagcacagaggaagaatgtacagcactccaggcaggaaagtatcttgcacgaaggctgcccaatgtgaaatatgcggcagtttccggcggacgaatggcaagagaaacagcaatgaaattcacatcctcgattcctttggaacatgtgacttttgtcccgctgtgcggcggtgttgataaggagttatgggatattcaggcaaatacggtatgtgagtattttgcaagccactgcggtgccgccggccttcagctgcattccaggtttctctgatcagaaaattttcggaatataccattacttgaaagatcgctgtactggttctataataatgaaagacactgctcgttgaaaccatgaatatgaggagggattcatatggaataccgtaagtttggaaagcaatatgtcataaggctggaaaaaggagaagaggttgtatcatcaatcaaagatttatgtgaaaaagaaaatgtaaagctgggctctctgtcaggtatcggggctgtaaataaagtaaccgcaggtttatttaagacaaaagaaaagaagtatgtaagtaagacttatgaggaagatatggagattgtttcacttagcggtaatgtttcctgcatgaatggggaaacctatttacacttccatatcagtgtcgccaatgaagcaggagaagtccgtggaggacatctcacagaagcctgtatcagcgctaccggagaattggtgcttacagagatagaaggaactgtggaccgggaatacagcggtgagattggattgaatttattcaaattttaagaggagaagcagaaaattgcaaatattaacagggagacaggtttataaacagtataaagagtacagtcaggagaaactgagtctgtgcggatgggtcagaagcaaccgggactccagggactttgggtttctcgtgatcaatgacgggactttttttgaaccgatccagatcgtgtacggcaaagaactttcgaattttaccgaggtgaagaagctgtctgtcgggactgcggtgatcgtgaaggggattctcacagagacaccggatgccagacagccgtttgagatacaggcagagtccgtagaagtggagggtgaatctccgtctgattatccgcttcagaagaaacggcattcgtttgaatatctgagaacgatcgcccatttaaggccgagggccaacacatttcaggcggtgtacagagtccgttctctgatcgcctacgccatccataagttttttatggagagagattttgtttatgtgcacacaccgataatttcaggacaggactgtgagggtgccggggaaatgtttcaggtgacaacgcttgacctggaggaactttcccagggcaaaaagctggattacagggaggatttttttgagagagaaaccagtctcacagtcagcggacagctaaatggagaagtctttgcccaggctttccgaaatatctatacttttggaccgacatttcgggcggaggaatccaatactacaaggcatgcggcggaattttggatgatcgaaccggaaatggcctttgcggatctgaaagacaatatgctgttggcggaaaaaatgatcaaatatattattaaatatgtactggaacaagctccggaagaaatggagtttttcaataaatttgtggacaaaggtctgctggatcgcctgcgtcatgtggcggagtcagaatttgcaagggttacctatacagaggccattgatattttgaaggagcacaatgataagtttcaatatccggtatcctggggaacagatttacagacagagcatgagcggtatctgacggagaaagtatttaagaagcctgtatttgtgacagactatccgaaggagattaaggcattttatatgaaacagaatccggatggaaagacggtggcggcagtggatcttttggtgccggggatcggggagatcatcgggggcagccagagagaagatgatctggataaactgcgaatgagaatggaagaacttaaaatgaatctatctgactatgatttttatttggatttaagaaaatacggttctgccagacactcaggtttcgggcttggattcgagcggatggtcatgtacgtgacgggaatggcaaatatccgagatgtgataccgtttccgaggactgcggggaaatgtgagttttaaaaatgttatgtatacttatttgtcagaaaaatggaagtggttcagtgcttccatttttttgtatagaataagccaaaatacatatgctataaaaaaagaggtggtttgatgcattccttatggcaggaaaaaatagagtttccatattacccgattttgaaaacagataagcaagtcgatatattgtatctggaggcatcccttcagaatgcagtggaggctcattttcaaaaagagcagggcaaatctgtgatgatcatggaagagaaaagcatcgcggacatgacggagctcggaggaatgggaatcattaaaggagaaacaaaagaagagatcaaagatctgcacagactgagggattatatagagggaagaaatattccctgtgacatggttgtggaatccgacacctgtatctgggtccatccactcaaactgtttttgtttatgacagagggtatcgatgtatatgaacagatgaaggttatgggacgtaagggcaataaactggatacgggaaccgtttatataacggcagacacggtcgttgaaaaaaaagaaaaagaaccgctgtatgtacatgcatttttaagcaaaggatttccgaaacttgagaaaccatacaaggaaatgcgaaggtacggagactgttggcttatctgtacagaggaagaaacggtagaaggaagtgatttctcctggattatatgatagaataaaaacaaaaaatcaggaggacattatgagcaagattgaagaaatcagaaaagaaatggtagcagccatgaaaaataaggataaagcaagaaaagaagctttgtccatggtgttaagcgcattaaaaaatgcacagattgataaaagagaagaactcacggaggcggaagaaaatacaattattgcaaaagagatgaagcagacgaaagaaactctggaatcctgtccggcagagcgcacagacattattgaggaatgtaatatacgccttgcggtcattaaagaatttgctcccgaagagatgagtgaggaacagatcaatgctgagattgatgtggtgctcacagaactcgggatcgaggctccaggtgcaaaagacaagggtaagatcatgaaaagccttatgccgaaagtgaagggaaaagccgatggcaaactggtcaatcagcttgtggctgcaaggattggataggaggctgtatggaacatattttagtggtcgttgatatgcagaatgacttcatagacggcgccctggggaccaaagaggccagggagatcgttgaggcagcagcagagaagataagagagtttaaaggcagtatatacggaacattagatacccactccaaagattatctcagcacacaggaaggtaaaaatctgcccgttccccattgcatcctgggagaagaaggatgggcactgcatcctgatatcatggatgccatctctgagacagaggcagaagtgatggacttctgtcggaaagatacgtttggttccattgaactgtgcgaactgctgaaacagagatatgagggaaaggacgcagaaatccaattcatcggcctgtgcaccgatatctgtgtgatctccaatgcactcatggtaaaggcagcccttccggaagcaaaattgatcgtccacgcggacctttgcgcaggagtgacaaaagaaagccatgacaatgccctgaatgcaatgaagatgtgtcaggtggacatacagactcagaaagagatttaaataaaatatacccacagaaagaacggtgttccctgtgggtatacatttttatctaagaaaatgtcaaaaacttatacatgttcaatgtccgtatactctgatatctccctgttggttgtcctgagatctgaaacactcagatcatggatatttgcatgaccggtaatgcgtccgaacatttccagctcagacctgcacacattcagataattacagagacgtttggccgaatggtcaacatgaaggcgttttctcaattctttatcctgggtggcaacaccgaccggacattgtcctgtattgcagatccggtactgctggcaggcagcggctacaagagcagcagaagcgatcgctacggcatctgcacccatggcgagtgcttttgtaaaatcccccggaagcctgagtcctccggtgataaccagatccatggaaaggtgatggcggtccagatattttctggccctggacagcgcaaagatcgtagggatggaagtgttgtcttttaatgtccggggactggcacctgtggccccgccccgcccgtctatggtgacaaagtcggcatcggcatatgcgatccattcaaggtcctgttctatatgcccggctgcgatctttacgcccacaggccttcctccggagacatctttcagccattccaccattgtttttaaatcctctttggaattaagattcggaaatttggaggggctgatcacgtcctggcctaaaggcttatttctgatctttgcaatctccggggtaactttgtctccgggcaggtgcccgcccatgccgggcttggttccctgtccgatcttaatctctatggcgtctgcgctgcggaggttttcttctgtgacactgtacaggttcggaacatattcaaatatgtacttgtaggctgcctgacgttcttcgggaaggattcctccttcgccgctgcacatggcggtcttggacatagcgctgcccttggcaagtgcggtttttaactctttggacaaggctccgaaagacatatgggatacatagatggggtgatatagttccattggctttttagccttcttaccgataactgttttggtgtctacaggatcgcccgcatttaatggtgccgggttcagctgggcgcccataatcaaaatatcatcccaggatataatgggctttaaggtgcccatggcatcaactacagacgaacccgtaagagccatctgatgtatggcatccatctgaggaaattcatttgaaccggactttgcaaaggcatcggggtaagccaggggattgtcctttgcgggagcaggagttcttttgaattccgtgggctcaaatttatcttttgatgccttgcagaccggacatgtatagtcagctcccagcaaagtaaagggaattgattcggcttcttcgtcgtagacgtagccgcagatactgcatttaaaaatactcataaaaaacctccgattcgtgttataataaaaaatattgtcttatgttataaatttggggtcaaaagattttttgctcacagatacagccttgcaatgaaataaaaattattcttattataccatatgaatgagaaattgtatcagagtcaaaacaatttttggaggaaagaatatgatttttgaaactcatgctcattacgacgatgagcagtttgacaaagaccgcgaagaactgctggattctatggagaagaatggaattggtacgatcgtaaacgttggttctaatatggaaacatcaaggtggacggtaaaagccgcagaaaagtatccgtttctttatggcgcggtgggggttcatccgtcggaaaccggtgagatgaagacagaggatctggacgagcttaaaggatatgcgtcaaatcccaaaattcttgccattggggagattggactggattattactgggacgaacccgaacgtcctgtacagagaaaatggttcgaggcacagatggagcttgccagggaaacgaagcttccgatggtaatccacagccgggatgccgcgaaagatacggaggatatgatgcgggcagcccacgcagaagagattgggggagtggtccactgcttttcttaccccaaagaaatggcaaagaagtttttagatatgggattttatcttggaattggaggagttgtgacatttaagaacagcaaaacattaaaagaggttgtctcctatgtgccgctggacagaattttgctggagacggacagcccttatcttgcaccggaaccgaaccggggaaagagaaattcctcattaaacctgccctatgtggcggaacagattgccgtgctcaaagggatcagcacgaaagaagttattgaggtcacagatcagaatgccagaatgatgtaccggatgaaagaggtttagatggagaagttaagcagcccaaaaaaaacaatagagatcattcaaaaatataactttgattttcagaagaagttcggacagaatttcctgattgacagtcatgtgcttcagaagatcatagacgcagcacacataaccaaggacgattttgtgctggagataggaccgggtatcggcacgatgacccagtatctctcagaacatgccagggaggtcatggctgtggagatcgatcacaatctgatcccgatcctcaaagaaactctggccggatatgacaatgtggaagtcttgaatgaagatattctgaaggtagacatcgggaagatcgcagaggagaaaaatcagggaagaccgatcaaagtcgtggcaaatctgccgtactatataacaacgccgatcatcatgggactgtttgaaaagaatgttcctatggacagccttacggtcatggtacagaaggaagtggcacagaggatgcaggcagtgccgggcacgaaagattacggtgcgctgtcactggctgtccagttttatgccgaaccatatatcgtagccaatgtgccgcccaactgctttatgccccggcccaaagtgggctccgcagtcatccgcctgacaagatataaagatatgccgataaaggtaaaaaatgaaaagctgatgttttccattatcagggcttcttttaaccagagaagaaaaacactgcagaacggaattaacaacagcagcgcacttcatttttctaaggaacaggtggtggaagctcttggggaaatggaactttctccgacgattcgtggtgaggcactgagccttgaacagtttgcaaggctcagtgacctgctggagggctagagagccagaatccagtagccgaagtttcctgtcttttggcaggattccggcacggttaagaaatctctgaatccaaaaagttttgcgatgaaatttttttcattgtcaaaaacgcctggaacgcccagatagatcctgtttgtctgtctgtgctgacataacatcagatgtccgtaatttccgtagttcagcaaaaggaatccgttggtcttcatattttccggcacatgaggaatattctgaaggtcatctactttgattttgatgctaggatccagcttataagaaggaggtaagggcaaggtgggatactccttccagtcaaagagactgggtgtgttcggcattccctgttctttggctttcttttctagttgaagggcttcaatatattctgccagttttgaatcaggatcagcagtacgttcttcctgctgtccggcagtttcttcttttgacggttcctcttcattcaatgattctgcgctcacaggttcagtttccggaacttccggttctacatagacacggggaggctgacctgccggttcgggcgccggttcgggcaccgtggattccgtttcaggggtcccggcaggaatcggaatttcctgcggaagttcatcaaaaggatcttctatcggaggaggctcaggagcgctggacggcggttcttcttcatcttcctctggaacttctttgtctgatggagcaggattctgtacagggccggactcaggtatactttcttccggggcaggttccggcggttctgtaaccgctggagtggggccgggaagactttctccctgagcaggttccggcggttcctgggtttccagaacaggagcctcaggttctatgttttcttctgcctggacagcctccggcttctctgccatgtcttctgtcggcaggaaatttcgtatagtgatcggtttgtcatcccactctgatccaaaaaaatggctgttggagtgatagatcaaaaagccgtccacctggtccagatctacaaccagagggtaagtattcttaaactcaatgatggtgtcattgcgctggaaggaatctaataagatgccttccatggttccgtgacggaacctgtaaaaatagattttgtacgttaaggcctcgtcatttgttttgacatggaagtataagcgaagctgtttttgacgcttctcaattttggcgaatcctacattttcgcctttcatgccattgctgtattcgtatagatatgaaacgattcgttgatattcagccaatgtgatactctctttttgatttattctatgaggagggattaaaaaatatgaccggaggaagacagaatgaatgaaaatgaaaaatttatgaaagaagccataaagcaggcaaagaaagcggcggctataggggacgtgcccatcggctgtgtcatagtatcggacggaaagatcatagccagggcttacaatcaaagaaataagagaaaaacaactctggcccatgccgagttattagcgattgagaaagccagcaaaaagacaggagactggcggcttgaagaatgtacgatgtatatcactctggagccgtgccagatgtgcgcgggggctatagtccaggcgagaataccaaaggtcgttatcggggcaatgaatcctaaagcgggatgtgcaggctctgtcctgaatatccttcaaagggaggaattcaaccatcaggcggagattgaatcgggagtcctcggagaagaatgcagccggatgatgagtgattttttccgtcagctgagaaagaagggataagtattgccgataaggataatgaagtcccggcatatttctgaaattcattccgtaccacctgataatcagggaaagaggaaaaaacatcggccttacagctgttgatgccatgactcctgactgtgtcaaggaatggctgataagggcacagatccgagtacattttaaaatattcttcagttgtaagcagctttgtagtgccgtcctgcattggataattcatagtctcaccttcctttatcctatcaattatagtactgaaagggaaaaatacaatagaaaataaaataaaagttgacgaatgtgaagaatatttagtataatcaaatctgcacacataatataattttaatacgtcaaaaagcttccgtgcagccggggaggcagcggtgccctgtatctgcaatccgctaaagcagaggtgatggcctgtttcgggcttttctctgtggagctgcccttcataagtggcgttgatgtttgggtcttacgcaatgagaatctatgaaccgtgtcaggtcgggaacgaagcagcactaagtagaacctttcatgtgccgtaagggtgcctgggctgagttaactgtgaaggtaacgtctgtggagagagttcaacgcaggccgcacggattttaaaatagaatatttgtatttagaaaccgattttaaggcatagctttagaatcggtttttatttcataggaaagttctacgaccttccctatgaaataaaaacgctccgcgggttgtgttagggaatccactttttttagaaatgccccgttatgcatagaacaatcggcagcaggtaaatcttccagtatttgtgctatatgcatagacttcgatttcctataatatatatgataagataaaggttcatcaaatatttagattgaaaagagggaatccatttggacaaaagaagcaatcaaatattaaatcaacttttggcagggggcagactgcagctgacggaaatttcggaaaagtatcagatttctgaacggattgtgcgcaaaaagatcagagagctgaatgacgaattaaatgaaaacggactgcctccggtaagtataaacggagagggaattttaaggtttgagggcagggaagaaggacttttggaacagatccaaaagtttattacgaaaaatgatttttatacatatcgcctgtccaaaaatgaacgaaagacaatacttgctatgcttcttttgaatcatgagaagtatgtgacggcagcctggatttcagagtacatcagtacgagcagaaacacagtgatcagtgacctgaatgatctgaaggactggtttttgaaaaataatatgaaacttgtttcccaggtacaaaaagggtatattgtagaagcttcggaaggagacatacgttccggtatgctgaagctccttgagctgaatctggatgaagaaaaatatggtgcaatgggtgctttccacgtgttcggacatcttctcctgaaagaaattcaatatcagggacggtatgaaaccatacaaaaggttttaagggaagaagaattgaggtatgactgctttctttccgacttctctttttcggtggcagtctatgaactgctgatcctggttgaaagggtaaaaaaaggaaaaacaatagaaaaggaaagacagccggactggggaaatgcatcccagagctcaaaatatccgctgagcaggactgtactggaccggctgggagaagaattttcactggatataccggcagcggaagcagaaaattttgtattctgcctcagaagaaaaagctatctgaaaagcggaacgaacaatgtagaacagctggtgatccctgtgctgatcggggaggtcatttaccgtattatcagcaggtttcggattaatttttatctggattttgcactttacgatctgctggtggatcatatgaaatcttctatctatcggatgtcttcgggagaggtcctggaaaatccgtttcggggagaaatcgaaaagggatatcccgaagtgttctgtacggtggaagaatgtctgaaaccattggaggattatcttggggtgaaagttcccagagatgaagtttcctttctcgtcatgtattttgcatctatgctggagcgggacaaactggagcggatgagggaacagaaagtgcccgcagtcctcgtatgcgcgatgggaaggggaaccgtccagctcatgctcgcaaaactaaaacagctggaggatgtacttgagatcacggaggtgagatcctcacatgaactgaaagatatgggaaacataaacgatcagctggtgatctccacagtcacatttcccgaaggggagatacaaaacatcctcatggtcagtcctctgctggaacaggaagatatttacagaattcggagaaaggcaacaaagttaagggagaactggtccggagaccagacggcagagacaggaaaatttctcaaaatagaagaaaagaccgagaggaattctcttggagctatgctctcggcagacaggatcgcactgaagcaggaagcgcaaagctgggaggaaggggtcagagaagcaggcaggcttctctatgaatccggggccgtcacctatgagtatatagaagctatggtcgaaaatattaaggtaaacggttcctatgtggtgatttattccggcatcgcagcccctcacgcagagcaggaaaaaggggcggtcagagaggcagccagtctggtgagccttaaagaacccgtgatatttgggaacagtgaaaatgatccggtcagttatattgtaggcttgagtatcttaaactccaacagcattaactgtgctatttataacctggtgcgtctgttttcccaggaagagacaaaaagccggattgaggctcaggaatctccggagggcatgcttgagacaatccggaggctggaagatgaatactgcagataaggtaaggagcagaaccttttgatggttctgttctttttttgccaataaacaaacatatgccaagcttatatatctttattagtacaatttagtgctcgtttcaatgacttctcttgtcctttatagggtatcttctgaggcctataatgaacttaacaaaaatacagacaaatacacttgagatcggagggaaccatgatctgggaaaacttaaaagacacattggtacagacagatttgagggcagaaaatgaacaggagatatttgaacagttaggaggtgtgttagtttcagagggctactgtaaagaaagctatgtgaaggcgttaagcgagagggaaaaggtttatcctacgggagtcttagcaggaaatatcggtgtggcaattccgcacacagatccgtgttatgtagaaacaactggaatcgccattggggtgctgaaagagccggtatcattttttcacatgggaaccaatccgaaagaaaatgtgaaagtcccggtgaagtttgtcatgatgctggcaatcgcgggaaaacagcatttggaagtgcttcagagagccattcttttaatacaggatgcagagattttgagaacgcttgtaaacgccgggaatccggaggaaatcattcaaatcatcaaaaataaggaggattcattatgaggacttacagaattttatcagcatgcgggacgggaatcgcaacatcaacggtggcatctgagacgtgcaaacggctgctggcagaaagggggattccctcagtggagatctcggaatgtaaagcgctggaagtagtcgggagagctgagatttttaatccggatgtgatcatccacactgcggagataccggtaactgagttaaaagagtataaaacctaccgaacgctggaatttatcaccgggtttggagcagaagagaaagctgatgaaatagcagactatttgaaatcattggagtaaaggaaaaagaaagggaggaaagctatgagtgttttacagtacatcttggatttaggttcatctgtggtcatgccgctgatcataaccattctcggactggtcctgggtcagaaattttccaaggcattccggtcaggtatgaccataggcatcggatttatcggaattaatctcgtgattggactgatgggagacttcgtaagccctgccgcgcaggcaatgacacagaggtttggaatgaatttatcggttattgacgtaggatggccggtcagcgcgtccatcgccttcggcacacagatcgttccatttgtgttcctcgtctgttttgtcttaaatattattatgcttgctgccaacaccacaaagacactgaacattgatatttggaattactggcacttcattttaaccggggcgctggtacagtttttgacaggaagtatgattgcgggagttatagcatcaggcatcacctttatcatcattatgaagctggcagattactcagcaccaagggtgcaggaatatttcggccttccaggagtttctctgccccacacagagaccgtgagctgggcgcctatatgcattttaatggataaggtttatgacaaaataccagggatcaataagattcacttcgatggggaaacgatccagaagagatttggaatcatcggcgagccgatggttttaggactgatccttggagcaggccttggagctttggcgggatacgagcctaacaagatcgttaccctcggagtcaatatggctgcggttatgttcattctgccgagaatggtaaggattctcatggaagggcttatgccgctgagtgaagacgcgaagaaattcctggcaaagaagtttccgggaaaggaagtcaacatcggaatggatgcagccatcgcaacaggatctcctatggttatctcggctgcactgatcatgattccggtcactcttttgctggcagtaatccttccgggaaacagagtgctgccgctggtggatcttgcgacactgccattctttatgatctggccggtcgtggcgtccaaaggaaacctgttccgctcactgatcacaggaacactgatgatgattgcaattttatatattgctaccaacttagcgggaacagccacgttgatcgcacagtcaacagactttacgtttccggcaggggcaaaggcgatttcttccctggatacaggagcccatttagtaccgtacatcatatataagattgcagaattttttcagatgctgttttaaaattttcacataaggaggctatatgctattagaaaaagaaagaaccaaggttatcgaaattgcattgaaaatacaacaggagaagctgattcctctcacattcggtaatttcagcctgagagatccggagacaggatatgtgtgcattacgccaagcggaatgccctatgagactcttcatccttcagatattgtggttgtgactgccgataaccagatcgtagacggggaacgccggccgtcaattgaaatgccgcttcacacagccatgtaccggaggcggccggatgtgttcggcgtcgtccacacccattccacctactgtacggcatgggcctgtgtagacggagggatgccgtgcatcacctcggaagcagcaggtctggtaggcggaaatatccgctgtgccgcttttgtaccgcctggaagcgacgaattggcagaagtgacttcagaggcgattggggatgacaaagcagtgctgatgggaaatcacggagcaatttgtatcgacgagacaattgacaaggcatataatgatgcaattgtacttgaggaaagtgcaaaggtggcgtatctggcttatcagatggggaatgtaaatacgctggaagaccagatgtgtaaatttctaaaagaagacacagatcaaaactatggacagaaataagaattaggaggatggaaacatgcaggggaaaatgaaagcacagatgttttatgcaccgggagatgtaaggtttgaggagacggatattccacagattaaagacgatgaggtattggttcaggtaaaagcagcattgacctgcggcacagacctgaaaacatacaggagaggacatccgaccattatcacttctgtaccttccacattcggccatgagttttccggagtagttgtggaggcaggaaaggacgttacaaaatttaaggtaggggaccgaatcgtgggagccaataccgccccgtgcttcgagtgtgagcattgtaaaaataagagatacagcctttgtgaaaatctgcagtatctgaacggcgcgtattctgagtatgtagccgtgccgtctcacattctgaaatataatttttatcatgtgcctgaacatctgccgtttgaacaggcggcacttctggaacctctggcatgtgcggtccacggaagcgatcggataccggccaaggtgggagacaccgtcgcagtcatcggggcaggacccatcggactcatgtttatgaagctgttaagcctgaaaggatgcagagtcatagccgtagatttgtcggattaccgcctggagcagtctgagaaattcgaggtatggaaaactgtcaatgcctccggggaagaacatataaaacaagtgagagatttgtgcggcggaaaaggggccgatgtggtcgtagaagcaacaggattcccggaagtctgggaaaatgccgtaaatatggtgaggccgggaggaacggttcttgcattcgggggcaccaaagcaggcacaagcattaccctggactgccagaagttccactatgaggagatcacactgaaggccgtttatcatcacacgccgtaccatgtacagctggctctgaaactgctgtccaacggacagatcgacggcagtctgttcatcacagggcattatcctttagaaaaagcaattgatgcactggagagcatcggcaggcaggaaggcatcaaatacgcaattatcccttaaaataaacgtccttcaggcttggcgcgctttgcgcgataaggtatacccacagggcacaccgtaatttatgcccttcgggcttggcgcgctttgcgcgataaggtacaatagttattgtatgaatgttgtttgaaatggagggtcttatgagtacgattacggtgattggagcaggagtgatggcgtcaagcctttcctttcctgctgtggaaaatggaaatgagatgcgtcttacaggcacgccgctggacagggagattattgattcggtaaaggaaaaccgttaccatcccacactcaaaagaacgctgcccgagggcgtaaaggcatttcagattgaagaactggatgctgcgctttctggctgtgatgcagtgatactgggagtcagcagctttggggtggattggtttattgaaaatgccctggcaaagataccggataaaataccggtgatcgcagtgaccaagggtgttaaggtatatgacgacgggacgatccagacatttcccgaactgtttgaatcaaaagcagagaatggaaaaagccatgaattctgtgccatcggagggccctgcaggtgctatgagctggcagaccatgacgatacaagagtcgcattctgtggaaagaacatggaagtccttgagttctttaagaggcttttagagaggccgtattatcacattgatctgacacaggatgcagctgggctggaaattgcggttgcccttaaaaatgcatatgctcttggagtcagtcttggcatcggtctggaagaaaaacagcagaaatatatgtgcaacactcagtctgcactgtttggacagagctcttatgagatcatgaaatttgtccagtacatgggaggaaatgttgaaaactccattcacggaatcggcgacttgtatgtgactgtcatgggcggccgttcaaaggaaatcggaaaaaggctaggggcaggtatgccatatgaacaggctatggaagaactcaaaggtgtgactttagaatcagtggtcatcgcccgacgggcggcgaaagctgttagaattctttctgagaaaaatcagatgaaaaaagaagatttccctctgattttacatattgatgatgttttgcagcacggatcaatgctcgatataccttggaagaagttcagagtaaatgaataagaaataagttcagattctatatctccgggacggcatgaaagcgttccggagatatcggcagttataagggaggtacacatggagttagggttatcgggaaagacggcagttgttacagggggagcaaaaggctttggacgggcggtctgccgggtgctggctgaggaaggcgccaatgtggtcatgaattaccgatcaagaaaggacgaggcggaggcactgatccgccaaatgaaccgggagtgttccggaaaggtctttgggtttcagggagatatgatggaggaatccgacaggaacggactgtttttggctgcttgtgaacagtttggaggcgcagatatcctcgtgaataatgcggccgcctggacaacttccatggctgccaaaatgccggaagaagacttccgcagagttctggagatgaatctgacagtgccgtttctgctttctcaaaagctgatttgccatctcacggaggcaggaaaaaagggaagtattttaaatgtggtttccaaagcgggcatcatgggatcaaaaagaaatcattcccattatgcatcatcgaaagccggtctgatcgggcttaccaaatctcttgccagggaaactgcagaatacggaattactgtaaatgccattgctccgggatacatgaagacagacatgctcatgaaatcttttaaggataaaaaagacgaagaagaacagaacaaaaagatacccataggaagaattgcagatccaggggaagtggcaaatgcggctgtcttccttgtgtcagagagggcttcctattttaccggaattacttttgatgccacaggcggaatgctgatgtgctgaaatgtcataaagatttcacattgataagtttgaaagctctctgtactcatgataaaatattctttagaactggcaggcataggagagccagtcatgatacaattcagaaagaggtgtgaattctatggcaaagattgaattacctgatgtaaaggatatttttttagaataccggaaaatgcagctgttatatcagtcagcgcttaaagagatcggaacaaagcttgagatattaaatgacgaatttaaatttgtgcacaaatataatccaatcgaacatatcgaatcccggatgaaaagtgaagagagtattgtccggaagctcatgaaaaaggggcaggatattacggtagaaaacattgagagatatattgacgacgtggcagggatcagagttatctgctccttcaccccggatatttaccgcatcgtagacatgatttccaatcaggacgatattgaagtagtaaaaatcaaagattatatggtcaacccaaaacccagcgggtacaggagttaccatatgatcgtgaaagttccgatctttctctcggatacagtcgtaccaacaagagtagagatacagatccgcacggttgccatggacttttgggcgtctctggaacacaagatttattacaagtatgacggacatgctccggaatatatccggtcagaacttcgggaatgtgcagagatgatcagttatctggacagcaagatgctggccatcaatgaagagattcacagccttaaacaggaggatatgcgcagataacttaaaaattttgtaccttttttctctcctttctcatagtatattatcagtagagaaaaggagcagcgaaaatgatggatcgtgaaggtttgggtgatctgcctacatttgatatggagtctctttccagaaagccgatggtgatgatggatgagcaggatgaggacgattatcagtacattacgaggatgtatggaccggttgcaggaaaagtacttgagtacattgaggatgcatgcgaccagttggagtacaagggaagtatgatgtttgacgagtatctggaccgtacaggggttcttgtacttgccgatcatatctatgacaagatcaaggaaatggaaaaagaagactgtattaaaaaagaccgccttctttatcagatggtatgcacactgctgggaggagaactctatcaccgcagatgccgttacaggagaaaatgcagaatgttttctgattaaaaaacatatgtatgaagacagagatgccgcaaaacagctggagtacagttgttttgcggcatcttttgtcagtcggtgccgggtttgttctgccatgctttataaatttcttcctttgaggaagaaggatagagtctgatcatacggcaaatggaggcgatagtctgaggatcttcctctaaggcatcggctatctctgcctcagtttttcctcgctgcatctttttttgaaccagatcaattactttggtatattctccttcttttctgctgtactccatttgggtgacgtaatctgaaagatttttttggcggaacaaatattcgtccatacgttcaggatcgcgttccagcaattcaagttctctgatggcttcttcaatataaggatctttttctatcatggcacgttcctcctctccctctgcgcaaataaaacatgcccattgatataactttttatgctcttcttttacttttgaagagttcagttttggcagctcaatcacatgaacttcccactgatcgctgtataggctgtgtctgctgtcctctctcatatgaaaagaggagtaaaagtaatcggtgtcagtcagctgattgaaaccaagaatactgatatgaatggccttaacacaattggcataagcttctcctgattttaaatcctgagtgtatacctttgctaaataagacagagatcttctgtcccagtgtgcgtagggcagtacctgcatctctatgttgatttttccggtcccttccactacggtatacaaatcaagtatggaaagctttccttccagaagatctttggaaaggtggcggtcttttatatgaatggtcccgatcttttcaggaggaatatgcaggatactgcttaaaaatccccggagtatcttaggctgcttcatgatctgtgtgaaagcatagtcatttttaagtgatatattgttagactttttcatcttttgttatctcctttagtttatcatatatggaaagttttttcaatatcacctagtattttacaatataatcactaaaatgtcaaattatgtatttttggagatccagagagtatttttatgagataactaaaaggatctccttccctagcctgcactttgttaaatcattttctgactcgctttgtattctgccgtctgaaagcatgtcttcaaattcttttctggataactgcagtttttcacgcagtattgccgatacttttacatctgatgcatcattacttctgatatgcagcctaacaggtccgtcaaatgcagcacatccggttatcttgtaatcatatggaccgattttgcagccatttcgtttcaacaaatctgtattcatagcatatttatgggcaagtatttgatcattgccgtggaatttatccagaagttctctgctcactgcttttggatggattctggataagacagtcagattccatgtggcttcacagccggaacatttataaataagccagacgtccaggtattttctctgtgcattaaccctaaactgtccggaactgacaaactctttttgactgctgcattttttacagtaacgcacggcaggaggcggagtttggtactgtacctcccagacaaccgttctgagaaatttatttttcataaaatctccttcctgttctaattagaataggaaagagaaaaaaggcggattttctaaaattcgcttcacaatgtcacctcctgaattttttattctgaaaaaattctatcattcatttccgtcagcacaaacctcatccttttttatgaaaaaaagatgagccaatacggttttcatatccgtatcggctcacctttacatgttatgtatcattttctcctgccggatgattctttggatgcttttcagagacagaaaatatttttcagacaataaatcctggcgctctcccgcaagatactcactgaatatttgtgcattgcgtttttgaaaatactttaaagatgcaacagaactcccacggggcttttttctgtccgatcttcttggtatataaatgctctccccttctacatatttttggatttcttcaagaagttcaaggggaagtatatgtttcgctttcttatagctcatactgctctcctaaaataaaaaaattaattcagaacagcaagggctatttgttgagattttaacgttataaatcatgctgttattcagcatggctgcaaatagctccctgctatgcagcaaaaacaatgggatcaagcatatgaatttacctcctcttttattactagttattatatcattttttgcaaaaaataatagtcttagattaccagcgccgagtctgaattcataatttggtctttgtaattttttactatcgctgtcaagcagtctgctgctcttaaactttccttaaatttgttgtgtttcctcaggaaaacggataaaatatacagataggacagagagaatgtcaggaggatcttatgaagcgggaaaaagccatactagcagcagtctttggactgatttttattcttgctcttggaatatggaattatattttgataggaaaaaataatcagggtgtcagtgagacaagtcaggcatccctgcctgtgctgaccataaacaccggaggagaagagatcaatgaactccatggatacacagagtccgtggacgcatctttgatgagagattccatcacgccgataaaggaggataaattccaggtttttatgaaacacggaaacagctccatcgaagcgctggattataaaatatataaagagaataaccgctctgctctggaaaaaggagtagtagcttttcagcagaaaaaaagcggtgcggcagcggacttaaaagtcaagagccgtctggagtcggggaaaacatatcttttggctctgtctatagaagatgagggacaaaaaatcacatattatacccgcattatttacggtaccgatctgcattttgccgagtgtctgaagtttgcaaaggaatttcacgatgccactttgacagagggaagttcagaatatgtaaaaaaatatttggaagtaaaggacggaactatgacaaatgatctttctttcgttgatatttcttccaatcaggaggcagtctgctatgcatcactgaaaccaaaaactgagcgcatgtacgcgccggtcatcaaagaggccagctctaatgtgacatcggtggagtacagatttattttgtctgcagaaaacagcaaagggatcaagcagtactatcaggtgacagaatacttccgtatcagatattccaaagaccggatgtatctgctcaattacgagcggactcagaatgcgtttttccgctatgacgcactggaccgggcaaacaacagaatactgatggggatcacgcagatgaatcccgaagaactgatcagcaggaacagcgggcggaaagcggcatttgttcaggaaaatgagctgtggtattacgattataaaaatgcttctatgacaagagtgttttcttttgtgggagaagactacagagactcccgaaacaattatccgcagcacggtatccatgtgatggagatggataaaagtggaaacattaaatttattgtatatggatacatgaatcggggagaacacgaaggcaagaatggaatcggtgtctatgaatatgaagcggagagcggaaaagcagacgagaaagcttttataccggtgaagatccagtatgaaaatttaaaagatgagattgaaaaaggagcatacctgagtgacagcggaatgttctattttgagctggacggggcttactaccaggtcgatctggacagccgggagtcaaaaaccattgcaaaaaatatcagcagcggcatggtcgcagtctccggaaccggaatgcttgccataacggaaaatgaaacggacatacggatcatagatctggaaaataacaaagagcataagctccgctgtgataaaggagaacggatcaaaccgatcggttttgtgaaagaagaccttgtgtacggtattgcagatgcaggggatgtgaagacaagaaaagacggttccgtccagtttccaatgaaaaaagttgcaattgtcgatgacaaaaatcaggaacaggccaagtttgaaaagagcggaatctatgttacggacgccagggtagacggaactgttgtcgtactcagtccggccagacgctcaggaacagggtacaagagcatgaaagaggattatattcgctacaaggataagacggaggataaagcttcactggaatacggatatacaagcgaccgtctgaaccaggtatatctatcattccctgattatgtatatgtacagacagttccgaagtatttatcttctgcgctcagccagaccgggaaagagtgcagcgtatcctttgcgaacaatgaacagcggtataaaaatgtctatatttatgccggcggttcactgaagggaacttatacggatatggcaaaagctattaaagaagctcagaaaaacgcaggtgtggtagttaattcaagccagctgtacctgtgggaaaaaggagttatgaagagctacgggaaagtggcaaatattccgatggtgaaagcagagtccaaagacgagaccggaattgcctgtgtaaaaatgattacggattccgagggaaaggatgtcacctacggacagctgaagcggagcaaaaaagatgtttacggcatgctgtatgattctatggacaaaatggcagcagattacaccggatgtaaatttgaagacgttctctactgcatcagcaaaggaaggccggtcattgcaaaaagggccaacggcacatttattctggtcatgagttataacaatacaaagatcagatattttgatcctctgaaggaagaatctgttcaggcggaacggtcttcaatggagagagaatttaaaaaggcaggcaatgtattttacagctatgcgaaatagagaaggtgagacatgaagtttatacacattggagacctccatctcggagcttgtccggaaacagagaggggatggggggaagagcggaaaaaggatattgagcagagcctcagtgaagtcattgcactggccaatgaagaacaggcagacttcttatttctgtgcggagatatctttcacaaaaaaccatcattaagggatttaaacaggctggattcttttttgtcccagctggtatgtaccaaggtttttatgatcgcgggaaatcatgattttattgacgaaggatcggcatatctgcgatatcgtttttctgctgatgtgcatctgttcactgaaaaagaacttacgagagtataccaagaggcacagaatacctatatctacggtctcagctatcacagcagggaaattacggagcctttatatgatgaggcaaggccagggacagaagaaggtattcatattcttttagggcacggaggggacggcacacatagtcccattgattttcacaaactaaaatggtcgggatttgactatgccgcgttaggccatattcacagtcctgagatgatatcagaggatctgatcgcctacggcggcagcctggaacctttaaacaggacggagacagggcgccgcggattctttttgggagagatcacagacgaaaagaaagtcgtccgtttcctgccggtcaatcaaaaaagttatgtggaagtacgggtgaacctgacaaaagatatggatgatcaagaaattctctttgctgcggaagaagagatgaagctgctgggggaaaaccagatgtttacgctgttccttcagggctctaaaagagcaaggattcgtcctgattttgatctgctcggagcaaaatacaggatcgtggatattgttgacgagacgagggggagccgtacggaagattcgctgttggaatccaacaaagataatatcatcggtgccgtactgcgccgccttgagggaatgccggaagcgtcacgttttgccggggatgcatttgagcaggcatccaggggattatatcagaggcgccggtcagagaaacgggagaaaagatctgctttttatatccggaatatttatatcgacggtttcgggaaattctgcggaaaagaattatcctttgagcctggattaaatattgtatatggaccaaacgagagcgggaagactacaataaaagagtttatcgtgcatatgctgttcggtctggaaaaatccagaggcattgcagcgagatctgatgcatatactatatatacgccggtttatggaggaaattacggaggaggcatggagatcatatcggacggacatgcctggctgcttgagagaagctttcgcacgggagagaagtcttttaatgtgtatgataaagaatcaggtgaaaaaggtgatctctcaaagctgtatactctgagcctcggtgcatacacagatactttctgtattcaggaaggggacattcctccgtcaggaaatctctctatggaacttaccaactatacatccaatctgacaggcagcaatacagcagatataaagatcgatctggctctgaaggcgctgaaagaaaaaaagaacatgctgagaagaaaaagcagagaggaatcgatcgtcctgtctgagaagagggagcgttatctgaaggctcccgagtctgacggacagagcggaaagccgaggagtattttgttttttttgacggcagcagctgtgtttgcggcggctggctttgttcatcaggggttcttcgcaggctgtgctgtatttctggtgttatcggttctttcgattaagtcagaaaagaaggaaatgacagagcaggaggactttaaggaagaattaagaagagactatcaaatttttaaagaacaaacagaccgtacagaatataatataaatcaggcagatgcggccattcaggctgttttagatgccgccagggaattccgggaaaatctcggggaacagtttaacgaaaaggtcagtgagatcgtcagttatcttacgggaggagagtacgaaaaagtaaaaattgatgaatcactgtcttttatggtagaatataaaaacaggtttattgatctgaagtatttaagcgcgggaaccgtagagcagatttacctggctgtgaggcttgccgcgggagagattctatatccgaaggaaccagtcccggttctgatggatgatattttcggcaattttgatgatgaaaggacccggagggcgcttgattatttgagcaggtattccggcaggcagctgatcttatttacgtgtaagaaagagctttttcatcagctggaccggaagaatcagaaaatccactggatttccctagaggaaaccagagaataatgaaaggtggagaatatggctgaagaaacaaaagagacaaagaaagtcatttccaaagagaaaaaaccaaaaaagaagaaaaagaaaagaaagatccttgtcaagatctcgattgtttttctttttctggtggttatcggctggttcaccatcggaatgaaagtcatgaagctgagggcagaggctaaggatctggtagccaacacttcagagcagacatttaaggcaacacagacgagtgtcgtctatgatacgaatgggaaggttatcaccaagctgaaaggcgagaaggatgtctattatctgaagtataaagatctgccggtgtatgcggtggcggcgatgatttccgtggaggacaataatttttacaaacataatggggtagacttcaggggtatcgccagagcagcagtatcttttgttacaaataagggagaagttactcagggaggaagtacgatcactcagcagctggcaaggactgttttcctgacacgggagatttcctggcagcgtaaggtcaaagaaatgtttgtggcatggggtctggagaaggagtactccaaggatcagatcatggagttttacctgaacaacgtttattttgcaaatggctattacggaattcaggctgccagcaaaggttattttgataaggatgccaaggatctgaccatgtcagaagccgcattcttgtgtgcggtccctaatgcgccaaacatgtatgagccctatcatcataaggaaaagacaatgacaaggcgcgacaagatcctcaaggatatgtataagcagaatctgattactaaatcccagagagatgaagctctgagagaaaagatcacactgaaaaagaaaaaaactgagcagaagagaaattatattgaaacctatgtaattcacagtgctacgaaagcactgatgaagaagcagggctttgagttccgctatgtgtttgactctgacgaagacaaacaggattacgatgagaaatataacaagtcttatgctgagtgtaagaggactttatacagtgcaggataccagattcatacatctattgacctggatgctcagaaggaacttcaaagcagtatcgacaatgctctgagcggttatacggagaaggacaagaacaaggtttacaaagtccagggcgcaggcgtctgtattgacaatgagacaggcaaggtagcagccatcgtaggaggaagatatcagaaaaatgcaggattagggctgaaccgtgcttatcagagtccgagacagccgggaagtgccattaagcctatccttgtctatgctcctgctatggagagaggatatggaccgggttctatcgtgaatgacaacccgatgagtcccaaagacaaacacagggtcagaaactccggcggttcctattcaggaagtattacactgaggcgggcgttggagaaatcaagcaacgtggctactatgaggctttacgaggagatcgggccgaaatccgctctccggtatttggaaaagatgaactttaagagcctcgacgaaaatgactataagtattatacaacctgcctcggcggcttcacctatggaactacggctgaggagatggccagcggatatgctgcacttgccaatcagggcgtgttcagagacccaacctgtattgtgaagatcgaggattcggacggtgagactgtggtctccaatccatccaagaaaagaacggtttactcagccaatacggcttctatgatgagcagcgttttaaagagtgttatcaccaacggtacaggccggggggcaaaggttcctaatgtagataccgcgggaaaaacaggtactacaacggacaataaggacggatggttctgcggatatacaccgtactatacaactgcagtgtgggtaggaagggatgacagcagggtaatggccaacctgagcggttccggttatcctaagacaatttggagcaattttatgaatgctctccacaaagagtattcaggaggcaaaaagcttaattcctatgaaggcggaggcggaacaaacatgccgtccacaggccagacaacagcaggcacgacagaaaagggaagtaccaaaggtacaacccagacaacgactcacgctacaacacaggccacaacccaggcgaccactcaggcaacgacacaggccacaacagcggctacacagcagcagaacggtgatgatcgacgcggcgccggaaatgacgattgataaatagataaaggcagcagactttaataaatagtctgctgccttttcctatactgctgataaatttataaatgattcttttccaaatattctttgatgcgctccgttgggtccagaagttcgctgatggacccgttgtgattcagcgtatcgatcagcagagctacatatttgctcacatctgatgatacataccaatcacgctccaacagttccggtgtctggtaagtaagattggttgtgataaccttttcgatgataccttcttccacagccttgtcaaagacatcaagtccgtttgtgaacagaccgaaggtagaaagacaaaatacacgtctcgcttttcttgctttcagttctttggctacatcgatcatactctctccggaagatatcatatcgtccaagatcagaacgtccttgccttccagagaatctcccaaaaattcatgggccacaatagggttgcggccgtctacgatagtagaataatctctgcgcttatagaacatacccacatcaacaccgaggacattggccatatagatggaacgctgcatagcaccttcgtccgggctgatgaccatcagatgatcactgtcaaaattgactccgtcgcactgctcaaccagagactttacaaactggtaagtgggctgtaccgtatcaaagccgctgtttggaatggcgttctgtacacgagggtcatgggcgtcaaatgtaatgatattctgtactcctaaatgaatcagctcctgaagcatcatggcacagtccagagactctctggtgcttcttttgtgctgacggctttcatacaggaaaggcatgatgacactgattctcttggctttgctgccgctggctgcaatgagcctttttaagtcctgaaaatgatcatccggggacatagagttctgatgaccgcacagagaatacttgatgctgtaattcagcacgtcaacgagaatgtacaaatcggttccgcggacagattcacggatgatcccttttgcttctccggacccgaagcggggacagccggcatccagcagatagcttgccttgtaatactcatcatatccgggcatattctgatagcggggggcttcatctccgcgccagcctgtaatatacttatcaatcagattgccaaggcttttgcagctctccatagcgatgatgccaagattgccgtcgggaagggttttaaagtttcggtcagatcgtctcattataaatctcctttgtagtttgttcactctttttatatcactcccgaagcgattccgtcaagacttgcgggaaaaagatttctttaaacggatatcctcgccgtataactggcagatggtatagttctcaataattctggaaaaaatccgttccgtatagcggtctttcaaattacgcattgataaatttgtcgaaataagtgttgatttaccgctgagctgccgttcattcaggcagtggaacagctgggaagtaatgaaggcattgttaagctctgtccccagatcatcaatgaccagcaggtcacagtgaaaaataagctggtaggacatagggagattatccttgtgcttttgatatgcctgggaagtcagaatatcaaaaagctgaaaagcggttacatagacacaggtatatcccttatccatgatctctttagcaatacaatggcttaaaaatgtcttcccggtgcctgtggaaccgtgcagcagcaggttttccctggaaggaaaatgaccgataaaatcacggcattttttcagcacggcatggatattctgtctcggagaaggccgtccgtcctccagtagtttatcagaataatattgatcattgaaacggagaaaattctctttttcaaggatatgctgcatattggaatcagaataaatcaggcggatcacagcctgatggaaacaatggcacttttcggtaccgatatatccggtatctttacagtcgggacaagtataaacagggtccagataatcctcaggatatccatgatctaaaagaagccggcgcttttgttcagccagcttctgattcttttgcctgcaaatgtccatagagttatgatcttcagatgcgatcagctgttttcccaggagaacagcgttgtgggccatctcccggtccagctccctcatctgaggaatctgtgcatagacctgacgcctgcgctctctggagagattgtagctgctgagccggttcgcctcgtacatcctcatgatttcctgatattgttcattggtcagggacatctcagtcctcctttacagggtgtatctgcttttcaaaaagctgtttttccagctcgtcatagtcatagtcacgttcttcaaaattgtggaactggttgttcggctgtggggctgcggatttggatacagtccccgggcggctttccagtttctttacatcatccagtgaaactacatggttgtccttccactttttcaaaatactgtccgtatactggaattttggctggccgatggagcggatcgtgcggttgcatgcttctatgacgatgcttaagtcaaagccgtcggtcttgagccagcgcttcatgtattcgatctgtgccggtgcgggctggttattcagtccaaaggcatgcatgatctggtaatactctttctggtagttctggcagtgaagcttggcctcgtctgctgttcggatgccctcctgataccaggcaatcgctacggactgcatatagcggaagtttttcttgccgttggatacacagtaatctaccaagtgttcgatcagctccggtgacattgcaaggtcatcgtagaaataagagagagtattcagatcattggcggtgagcggacgtcctatgtacatttctgcgatatagatcagataagagaacttatcatccttatttttctgggccagctgggacggagtcagcgtcctcagggccggaaccgccttagctttcgcagccggagtcccggtcgtggtttcctttgctggtattttcgctggttcctctttttcaggctccatgagatcatccgcatcgatcgtcagggccgtggaaacggggagcagtttgatggaacggatctctcctccatccatgaccaggtccaggagattttcctttttccagtacttcagggcgcggcagatatcacgctccgtaagttccagcaaatctgccaggtaaggtatattgaacttctggccgttagaaaccatgcgcagaaggtaaatataaaccttcacatattctccgttggctttaatcatgtagtagtctacgaaggcattcggtaataaagttcccccggtcgggtatgttgtcgttacgttaatactgctcataaatccatctccctaactttagtcaatacgtctctttctttaatctaaaagaactataacgcagaccgaataaattgtaaatagcagctcttttcacagaataatccacagaacaattgtggaaactgtggataacgtggataagtaaacggaatccgcagaaagacaagcctcactcaaaaaattttgatgtggaaaaaataaagaaaaatccacagggaaagttatacacaattgtgtataaccctgtggataacgtggataactatttcttaactaactcattgccgatagaatcaacatttccggcccccatagttatcaacaaatcattttttttgcatttttttaaaataaattcttctatctcatcaaaatccttgatatatcgaacatcagtaccggttttttcgattttatctgctaaatctctggcgtggaccatgccggtgtctttttcccgggcagcatagatatcagtgatgatcacatgatcgcattggctgagagcctcggcgaactcatctaaaaaggcatttgtcctcgtataggtatgcggctggaagacgcaccacagatctttgtggggataatttttgcaggcattcaatgttgctttgatctccgtagggtggtgggcatagtcatcaatgaccgtaaagccctggcaggtccccttatattcaaatctccgcttggcgccggagaaggtcaggagtccggcttttacagtatctatggagagcccgaggaaatcagcaacggctgcagcagacagcgcattattaatattatgcaggccgtttacgtttaatgacaaggaatctacaaaagttccttctttgtacaggtcaaaatgtccatggcccatagagtcataggaaatatttttagccgtataagtaaagtcatcgttatcaatgccgtaggttacatacttggctttgagtccttctacgatataggaaatgtcatcaatctccccattcaggacgagcaggccgtcttccggaagcttgtgagcaaactttttgaaggagtcgcggatctcatcaatatcatggaaaaagtccatatggtcttcttctatatttagaataatgctgatcttcgggaaaaattcgagaaagctgtttgtatactcacaggcctctgtcacgaagacattggaatggccgacacggatgttgccgtcaataatgtccagaataccccccacagtgatggttggatctgtctctccggccagcaggatgtgtgagagcatagaagtcgtggttgttttgccgtgggttccggatactgccactgcatttttataattgtgcatcatttgtccgagcagagtcgcacgcttcataagggggatgcctttttgcagtgcggctttgtattcttcattttccggatggatggccgcagtatatacgaccagatcaatatcatccgtgatattttccgcgacttgtcctaaaaagaccttggcgcctaaagaactcaatttttcggttatatcggaggaacggatgtcagagccggaaacagtaaatccttctttgagaaggatctcggcaagaccgctcatactgataccgccgatccccataaaatgaatgtgaattggtttcttgaaatctatctgatacataggaattcctaacctttctctgattttaaataaagtgttttttctattatagtgcacaaaaaaataagttgcaaggaaggaaatgagaaacaggggttttcggtaaaaaaggtgtacagaatgatggaaatattgtcggattttgtactgctaaatagtaaaatacaataatatcagcgaaaatatataataatatttgttcacattttacgaaggaggtgctataataaacattatctaagatagtatgtacgatgttgatccctgcacaagcatcaggactggcttccgatttgaattttggaaggcggcaggtgctttgttttagagtatagatgtatacagtgggagtcatagtatgagcaaaatgtgttgagagtggggatattttgcggcgttgaaaagggaaggtgatagagcataaacggccgcacaacagatcattagctaaagttttgaaaactaggaggaagacaacatgcaaattacagatgtacgtatcagacaagtagcaaaagaagggaaaatgaaagcagtcgtttctattacgatcgataatgaatttgtagtacatgatatcaaagtcatcgaaggagaaaaaggcctgttcattgcaatgccaagccgcaaagctgccgatggggaataccgtgacattgcccatccgatcaattcggcaacgagaaacactatccagaccatgatcctggaacagtatgaggccatgagacttggagacatagatgcaagtcagccggaagaaggagcagagtaaacacttaattctaaatactatgattgtccataagtaacaggaacgggagatccgccgttcgctgatcagtagattaagacagcatataacatgactttcggagtcatgccatatgctgtctttttgcctttcagatgattttctgatatgctgtaaaaaaatcagaagcgggttaattatggatcatacatcaagggaaaatgcatttaaaaagttatatgaagaaagttatgaagagatgctcaaatttatgaaggggtttttttattgggactgggaggaggcctatgatgtccttcaggaagtatatctgacggcatatgaaaaaatagacagtctttcagaacatgaaaatcctgttggatggctgaaacagacagcaaaatacaaaatatatcatgtgtttgagaagaaaaatagaataggagagatactgacagacgaaaatataatgtcattaaaccaaaagttcgaggacgattatagcggcctgctggaaacggatattaaaaacgtactctcagaagacgaatttcgtcttttttatgatttctacatgaaaggatttactatcaatgagcttgcgagattcagggacagtacagatcaggcggtgaaatcaaaacttgcaagaatacgaaaaaaagtaaggaaacagctgtttatgcttattatgtttggctgaatgaagtcaacttaaacgacaccttcgcgtggtttttggggatatagatatgtaaccttaaaattcatgtgaaaggagccgaaatgagaaggaaggcatttgaacagttactagagaaagcggttgggaaatttgtagaggaaatccacccggaagatatagaagaggaaaaattatcggaggatgtaaaagaaaaaataaggacaaaaattacagatgttaataagacgcataaataatccgtaaaaatcgtcggatcttggttatgatttacatatatataattatctgttacaatgaatacaaaattcaaaacatatagaacaggtacaaaggatgagagattttataatcaagagatgggcttttgaatggattacagaattttttaaatccgaatcggatcaagagaaattacggcatatagaacatatattagaatgtatggagcccttaaaagatgaaggtaagcttgataaggaagtattctactgcggatatatagaaagaagaaacttattaaaaatcagaagaaggaagaggtactgctcgattgcagcaaaggcagcggtatttcttcttgtatttatgctttcagcacaggtcatatgttatgcgataatagggaagtctatttttcgttatattgatcaaaaaaatgaaaagacaacagaagtacagattgaaataaatgatccttcaggagaatcgcctgttgaatggttgatagagacgataaaaggctttgttgcacgaaatataactaaagataatggagcaaaatcaggaactaattttcgggtatctacctgggaagaagtaaagaataattataagcgggatgtaatgtatccaagatatatacctcgcggatggaggctgcaaaatatccttgttaatgttcttgacaagaaagtcataggtattatagcgtcttacagcagaggagaggccgtactgtattactcttattatgatcacagcggaacaacagacggttctgaaaagattctttttggagaggaaaaaacaaaagtgaaagtacttaaagttgctggaggtgaattcagtttttataagggagaaagaactttatcagtactgggacatgtgaatcaatttgaaatgaatattgaaggaatggtcagtatatatgaagctgagaaaattgctaaatatataaaatagaaatgggacaaagcactttggctttgtcctgtttttttgttttatcgcggtaaaagagcattaacaacagattgtaaaaacttcgccggccattttttatgagagagagaatgaggtccagcgaattaatcacaatctgttgttaatgccctctattacagcaactgaaataatatggaaatagtgaaatatattctcaagtttcgttaaaaagtgcagaaagaccaatgatatcatgaattcattggtctctctgcttgctgaaactcagatacttgtaaacctaagctgtcaacaagaggggtaaattcaaccattaaagcaggtttccgtacccgcttaaccaatttttagaatggtttgtgatttggatggttttcctttctttaatattataatagttaatatgtttttaggaataatgattgaaaaaaacccctctactatagaaactgtttttagagcaaaaaggtgaatatttttttgaaataagagatataataatttcagactgtagacaatcgacctccttttggaggcggttgtctatttttagttttacctgtgctttccagatggtataatagaatcatcaggaaaggcaggttttctttatgatggggaaaaagataacgcagaaagaacacaaatggaaatagcaagtctggaagatctcgtacccagaaaccatctggtgcggaagctggacgaagcaatcgatatgagtttcatttatgaggaagtcaaagatttatacagcgattttggacgggagagcatcgatccagtggtattgatcaagatcgccatgatccaatatattttcggaattccctccatgcgtaaaacaatccgtgagatcgaagtgaatttcgcttacaggtggtatctgggctatggaatgcatgaggagattcctcatttctctacctttggtaaaaactattccaggtgtttcaaagataccgatctgtttgaaaaaatctttgccaagatactttccgaagttgccgccaatggttttctggacacagaaagcctcttcattgacggcactcacatcaaagccagcgcgaacccgcataaatatcgaaacgaggtcatccgtaaagaagcacgcagctatgaaaaagaactacaggaagagatcgaaagggatcgtcaggaacacggaaagaagccgctgaaaaaaaggaaaaagaaccggaaatgatgacgcagaaggtcagtaccaccgatcctgacagcggctggttccataaaggggagcataagcaggtctttgcttatgctgccaatacctgttgtgacaggaatcattatgttttggattttgaagtaacagcagggaatgtgcatgacagtgtatcattctggcctttatacagacgtttaaagcagaactggaaatatggcgtgtattacgtgatggatgcgggatataagataccagcgatcgcccggcagttgataaaagacggaaaaattccagtcatgccatacaaaagacctatgagcaaagccggttatttcaagaaatatgattatgtatatgatgaattctttgactgttatttgtgtccgaatcaccgagtgcttcattacaccacaacaaaccgtgaaggctatcgagagtataaaagtgactggcttgtttgccaaaactgtccataccggggccgctgcacaaacagtaaggatgacgtaaaggtaattacgcgtcatgtgtgagaaaactacatggagcaggtcgaagatatccgtcatacaaccgggatgaaagaaagatataaacagcgaaaagaaaccatagagcgagtctttgcagatgcaaaggaaaaacatgggatgagatatacccagtacagaggtctggctaaaatcaagatggagctgaacctcttgtttggctgcatgaatctaaagaaactggcaatctggaaatggcggatcaaatggggagcaaaataccgctcttcttcattacaattttccttttccagtgcaaaatcagaatttgaaaagtggaaatggattaaaaaacggttcgcaaacatgacatcgcgaaccgttctgtctacagtctgaaaataatttatctataataatagtaaggatttttattatttattattgttagcgtttttttacattactgtagcatgtgtcttgatctaaaagttttccgtttttagatttatataaataaatattattttttacgcggtatttataaccttttgaaacataatatttccaagaataaccagttaaacctttgccagtatgtgtacctgtagtaatagtactccatttattgtttttgaaccgctgaagttgcatttttatttttacataattagaatcattagaaataagaactcttgtattcatttgtgcaaagccaagagaattaaattttaagcctgaatttacttgcagcaatatactaactttattttgtgtaaatgaatttaatggtataaatgagcctattgtattatttactgtatctggactagaagtgagagatgtaggtttcattgatgcagatattggtgtaacaccaattaataagatcattgcaaaaattaaaataatgttttttaataatttcataaatcctccttttatccttactacttaaaaaacagtaagaaaaataaaaaggtgattaatgattttaaatattaaatgttttatatatatgaaataagataattagaataaagaaaaaatttttgaatttcttttttttgtaaagtattacaaaaagcttgataagggaatttttcctattaaaaaagcttttatagaggtgttggcggacatataaaatagacaaaaataaaaactgcacacaatttgtgcgcagttttacattataatagtattggatcatttaattcttttgatgttttctccgatttttatcattttctcgttgtctagagtggagaaaattgtataaataaccttgccccttgaccatacaagttgattatactcactttctatataaaaatacttggtgtcagttgtctttattgttttatagttttggtcttctatatatttataaacattgattgaaggatcaataattatatcaattaatattgaatcatcaccgtttttgtattgataagagagattcgtagttgattgatcaacaacttttttttctaaaacgtatccatcaggcatatagttaaatacaaagtctacttcttgggtgttactaggtgcttcagttattttaagttcagttttgtctttcttattttgtgtcttaaaaataaaattaataactggctccctaaaagcctcaacactcatcaaagttacagaagccatagtaagcagcatcacaaatacagcagcaatccgttgggcagtgataaacctgcgttttctgtttgcccttttccttgccgaggaaaacatgttgtcaattttttgatttaattgatccgatagttcctcttccgggatattatcaggggagatttcgtcggtccagctgcttgcaccatactcgatgatatggtcaaacaattcttcatttttgtcttttttatcgtttgtactcataactcaatccctccttctcaaacagagcacgtaaggaactgcgggctagactgcaacgtttctttgcagtcagttccgaaatttgtaatagcgtcgctatttccagaaagctgaatccatagtaatagtacaggacaagaactgtctgctgattcgtaggcagcttgccaatcttatctaccattacatttaagtcaatatattccatgtaataatcatttggatcaatcaggaattctgaatcttcgccgtcctcgtaagtcagttcttcgtgattatttctgctctcaaccttgatcatgtcatacgctgtgttacgtactatgacatataaaaacgtaaaggccttatcatcgggcaattctaaaatcttttcagagtacagcaacgctttctcgaaaacattttgaagtacatcttcagccaacgtatcattatgaatatattgctttgctacatatttcagcttaggcgcatacttgttgtagagcagttcaatataatcaacagcgctcttggtaggaggtttattcttccgccgtatcattttcattctctcccttttcccccgtttatggtttctctctatatctctcattatagatagactttgcggtgttgtaaagcttgtacaaaaaaagcctatagaaatattctaaaggctttggtcttcttcgataacctggacctccaagaaatcaaagtcgatatcttcaataaaactgtcgtgataaaatcttgttttatcgtgggtcataaattcttttttattggcctccagccagagaggtttcggcagatcaaactcataacaaatgtcttcaagagccttatatacctttcgggtacggttcagaccggcattttccacgctgattacagtgtctttcagcagccggttgcttttcattagttttccccacatacggaacattggttttacctgctttctatttgaaatatattaagtataatagaagataaatataaaacagtcaatattgtagtgagagagaaaatgatttaaaatgacgttaaagaagaatattgaggagaagatcgaatgaagattttaaaaaggttctttattgacggattgtccgggatggcacaggggttgtttgctaccctgatcatcgggacgattctggaacaagttggactgctgataggcggaaatatcggacaagtcctggcggttggtgcggcagcggcgaaagtgatgaccggggccgggattggtgtgggagttgcctcacgttttcaggaatcggttctggtaaccgtttcatcggcatgtgcaggaatgatcggagcttacgcatcaaaaatcatggcgggaaccctgattgtcaaaggggctgtcgtcctatccggacccggggaacctctgggggctttcttggctgcgtatgtaggaattgaactgggacgcctgatctcaggaaggacacagctggatatcctgcttacaccgcttatgaccattttatccggaggtgccgtaggtctgtttctcggtccatggatcagtcagctgatggcacggctgggtgaccttatccggtggggtacggagcagcagccgtttttgatgggaattgtagtatcagttctgatggggatggcactcactctgccgatcagttcggccgcgctcggagtgatattaaatctctcagggattgccgcaggagctgctgcagttggatgcagcgctcagatgataggatttgctgtggcgagtttcagagagaacagaataggaggcttgatcgcccagggaatcggcacatctatgcttcaggttccaaacatcgtcagaaaaccgctgatctggattccgccgatccttaccagtgccgtgttgggacctgtttctactatagtattcaagatgaccaataatgccatcggttccggaatggggacagccggattagtggggcagatcatgggatataagactatggtggccggcgggggttctccggctgcgaccgcagtcatgattattggaatgcatatcattgccccggcattgctgacctattttatatcagaaggtatgcgccggatgggcatcataaaacagggggacatgaaactgaatatgtgacagctttaagtcgtagcggcatgtttcgcaaaataccggacagaatcctctaccccgcatgcaatataagaggacagttccatgaccgtgtgaagccttgtggtttgtatggtgttgaagttggcctctgatgtgaaattcacgatgccggtgatagagatatctcctacaggcggcagttctttgtctacaccctgtccaggaaacagcggcatggaagacacggtcacatagccaacatgatccgcagaacccagacacgcatcaatggcgatgacaaaaggctccctgaacgagcggtaaatttcggtcattgtctgcgtaagatttccggcatgcaccggctgtgatagagtcccgaaaactttataataagaagatgtcattaactgatggcctaccaaaggcccaagacagtcaccggtagcgcggtctgtgcccacacacaggacgactacctgctggctgtcttttttctgcatttgaatgcggcggatcaaatctgcctgcagcaaggctcccgcttccctgtctttgggattaaaataggatattcggtctgaaatgcgcattgcgttctccaatcatttcttaaatatcatttttcgccgtataagacgctccatatagtttatacataaaataaaaaagtataccgtcccaatacgtacttcccacttgggcaaaattattttcttcagtcgacgccctttgataaaaaaattgaaaatactgtggtaaagtctttggtattaaagaggaaagggaggctttttcgtgagagcagaaaatcagttgccgaagaacatcagacagatcggcgggcctgtgggaaccacaaaagtttatatcgaagattttgtagtgacatttttaaaagcattgacgacggacaagaacacttttgtaagaggggccatattatttggagaaaaaaagagtattgataacgagactgtgatatttatcagaggagctgtggaagggcagaatatagagctggatttggacgagaccgtatttgacgataaggtttggcgggaaatttatcagaagaaagaacgtttctttccggatctggaggtgatcggatgggcgctttccagaatgggattctcagtgcggcttaacgataagataaaaaagactcattttgaaaattttccgggcgacgggaaagtgctgtatatgacagatcacctggaaggggaagatgcattttacgtataccgcggacaagacctggtgagacagagcggttattacatatattatgaaaaaaatccgatgatgcaggaatacctcatcgagcgaaatcaaaaattaaaagaagctgtatcttatgaaaccatgctggaagccaagagagatgaaaagatcgtgcggcagtttcggacaatcgtccaggagaaacagaaaagcagcaggacaaaggtcatgatgaagcggctttcttccagcgcggcaatgctcctcgtcctgatcttagccgggggaatgttttattattccagattggataacagttcatcctttggcgacgcgattcatggggcggtggagaccatgggaaaaggcgtgaaggacaatgtttcaatggaggaagaaaacaaggagtcaggcacaaccacgaaacagcttccgaccagcaccgaaaaagcagacgggacagaggcgggcactacggcagataagaaaaaaacggaaaccggcacaaccgcagccactgcgtcaacgcagaaatctgcacagtccatggcacgcagccgaacttatgtcgtcaaaaagggggacagtctggtatccatttcccgcagaatgtatggaagcagaaaatatatgtataaaatactggatgcaaacaagatcgggcctaaagagcatatctatcctggacagaaactaattattcctagtataacaaagtaaaatcatgtataataaagcgtgatattaataatgttaaataaaaatacaggggttttactatggaccataggatgaaatcagggttttccctctatacaaacagcagggaagcaatgcagaattcttttttgaaaaaacagatccggaaaaaacagaggatcattcttgggggggttttttgtgcggtactgcttgcaatctttctggcatatagatatcggacctatcatacgctcaagacagaacggacagtggcagaacatgtgaattccggcacaaagtcctttgcatataaaaacggctccataagttataacgaagatgggatttcatttattgacggtgacggaaaagtagagtgggagaaggcttattctatcaagaatcccattgttacatactgcggagattatatcgcagttgcatataagaacggcaatgagatccttctatatgacagcaccggaaaagtaaaaagattttccgcctcacatgcggtcagtgatgtggaagttgcggaacagggagtgatcgccgcaattttgcagggagataatgaaaattatatagagctttatgatgcttctcaaaagaagctggtaacgatcaagacgacgatcgatgaaaatggatatccgctggatattgacctgtccgaagacggcaccatgctggctgtcagctatctggtggtggacggactgcagacgaagaaccggatagcattttatgatttcggagaaaaagggcaggaaaaagaagaccggctgctggcgggatttgacgttaaggataccgtgatccccaagattcaatttatggggaaaaatacggtttgtgcgtttggagataataaaacaattatttttaacacaaaagacacaccttcgaaacaaaaagagattaaaataaattccaggatcaaaagtattgctgcagatgattcgcattttgtcctgatccttgagaataaaaagaagtcttccaaagagcagtatctggtacaggcctataaccgttccggaagaaaggttatggaaagagagatcaagacagaattctcggatgtgtaccttggcccggacggagtactgtttgtgggaaattatcattgctctatgataaattatgcaggccatgagatgtaccagcagatttttaagaaaaggattcaggccatggcacccactgggaaggcggaacggtacttgattacatttgaagataaaacacagttggttagattacgttagatggtgatattatgggacaaattattttaattgtattgctgctgatccttatatttgatacgatcagaggattcaagagagggtttctgaaatcgctcctccttttggcaacatggcttttgacctttgccattgcctactcgacggcggacactgtaaagcagtatgtgatacaggtgtttataaaatcagagcagaatatactcacagatcagctggcatattttattgcgtttgctttgatcgtgcttgtattgaaggccgtattttcaatactggtcggcataatcagcaagttcggagacctccctgtgattggatggttcaatcatttctttggaggggttctgggatttgtgaaaggaattattgtgatatcctttttactgtttgccatttacctttgtcagtacattggcttcaaacaggaatataatgaaatcatgcagaccagttctttgcttcagtttatggcagaaaacaatccggtgattacaatgttaaagggtgcgatgcctttttaatttttaaagaaagcctttgggaagccttgataacagggcattttccaagggctttttcctttggattttttacttgagtgttccttcgtaaaataatgtgagaaaaaagtaaaaaaacctgttgacatttgcctggagcgatgataagattatcaacgttgctgacaaaacagcagctcttcaaaactttatctgacttcttggctcttcaaattttttgaaaaaagtccttgacttggaaagcatgccatgatatgatataaaagttgctgacggtgatcggacagcactagaaatgtcagtcattcatgaaacttcaaaaaaatgaaaaaagtgcttgacagacagaatgaagaatgataatataataaagctgtcgctcgtaagagcaagacaaaaaacgacagcagatctttgataattgaacaataagacaaccttgaaaattctaagagattttcagtatcttttgaaaaagatacacgaacgttctttataaaaggacacagtaaaacaaggataaaaaagctagcgctttttagatccaagattgaacatgagagtttgatcctggctcaggatgaacgctggcggcgtgcttaacacatgcaagtcgaacgaagcattttggaaggaagttttcggatggaattccttaatgactgagtggcggacgggtgagtaacgcgtggggaacctgccctatacagggggataacagctggaaacggctgctaataccgcataagcgcacagaatcgcatgattcggtgtgaaaagctccggcagtataggatggtcccgcgtctgattagctggttggcggggtaacggcccaccaaggcgacgatcagtagccggcttgagagagtggacggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagaaaaaagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatctaactgaccggttcgtaatgggacctttccttcgggacagttaagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccttataggagggagctgccgaaggtgggaccgataactggggtgaagtcgtaacaaggtagccgtatcggaaggtgcggctggatcacctcctttctaaggaagaagaagtaggggttgtcttattgtttagttatcaatgataacaaaaagtatcaagcaaggaagttctattgcactaaattcgctgcgccataactggctggctcattaagttgcaaagaacaactttcgtactaagctcgaaagtacctcgctaagtactcaatgcttccggtggcgatgcgttttggggacacacccgtacccatcccgaacacgatggttaagaccaaaacggccgatgatacttggttggagacgacctgggaaagcaggtggctgccggatcttatttaaacattctttggtgattcgatataagaacaaagttcttgtatggaatggctgaagaagccaaaatagaaagtgtaacagagattgttggtggtgaaagcatctcagagacttcgtctcttcgatcgcggcagagccgctaatacaagcaaaaagtaattctgcttaggaatgtaaacattccacacagaattccgttttccttgtgctttcaatcctgcatacgcggatgtaccttgaaaacttcatacagaacacaaaaagttattttttataagaaatgacaagacatcaaacaaaacgaattacccgttgtcatcacgctagatgacaatgaggatgatagaacaactatcgtccgttctatggttaaagtagaaagagcgtagggtggatgccttggcactaagagccgatgaaagacgtgataagctgcgataagctgcggggaggagcaaatatcctttgatccgcagatctctgaatggggaaacccggcggagtatccctccgtcagcgtatggtgaatccatagccatacgtggggaacccggggaactgaaacatctaagtacccggaggaagagaaagaaacctcgatttccaaagtagcggcgagcgaaatggaaagagcccaaaccagaatgcgtgcattctggggttcggactgcgacatgggattatgtatgacaggagaacggcctgggaaggccggccagagagggtgaaagccccgtatccgaagtcagaagtaccctggcaggatccagagtaccacgagacacgagaaaccttgtgggaatgagcggggaccaccccgtaaggctaaatactccttagtgaccgatagcgcatagtactgtgaaggaaaggtgaaaaggaccccgggaggggagtgaaagagaacctgaaaccctatgtttacaagctgtggaacccctttagatggggaactgcgtactttttgtagaacggtccggcgagttgcccgtactggcaaggttaaggacttaaggtctggagccgaagtgaaagcaagcgttaagagcgcggtagatgatcacactttgtgtggtcataacagtcagtgagggcagacccgaaaccgggtgacctatccatgtccaggttgaagcttccgtaagaggaagtggaggaccgaacccacatccgttgaaaagggtggggatgaggtgtggatagcggagaaattccaatcgaacccggagatagctggttctcctcgaaatagctttagggctagcctcatcaaagtctgctggaggtagagcactgaattgtctagggggcgtcaaagcttaccaaaacatatcaaactccgaatgccagtcagatgattgatgggagtcagactgtacgagataagttggacagtcgaaagggaaagagcccagaccaccagctaaggtcccaaagtacgtgttaagtggaaaaggatgtgggatttcaaagacaactaggacgttggcttagaagcagccatacattgaaagagtgcgtaatagctcactagtcgagagatcctgcgccgaaaatgtccggggctaaaacacgacaccgaagctgtggaatgtagaaatacattggtagaggagcattgtaagcgggatgaagccataccgaaaggagtggtggactgcttagaagagagaatgccggaatgagtagcgagaggaaggtgagaatccttccggccgaatatctaaggtttccagagtaaagctgatctgctctgggtaagtcgggacctaaggcgagggcgagagccgtagtcgatggataactggttgagattccagtaccacataaaaacagaactgtggggacacagaagggaaatgggagccaggaatggaaagactggtgcaagcgaagtagccgtatgggaggcaaatcccccatgcaaggcaaaggcgttacgcggaccgaacaaaagtagggaagcccaggcccccagctgtcaagaaaagccgctattgttttttatgtgcccgtaccgtaaaccgacacaggtggatgaggagagaatcctaaggccgacgggagaagtgttgttaaggaactcggcaaaatgactccgtaacttcgggagaaggagtgccaggtaagactggccgcagagaattggcccaagcaactgtttagcaaaaacacaggtctatgcaaaaccgcaaggtgaagtatatgggctgacgcctgcccggtgctggaaggttaaggggagggcttagcgagtgatcgcgaaggtctgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacctgcgccaggacggaaagaccccatggagctttactccagcttgatactgggattcggtactgcatgtacaggataggtgggagactgagaaagaaggacgccagtccttttggagtcactgttgggataccacccttgcagtattggatttctaaccaacagccatgatctggttgggggacaatgtcaggtggggagtttgactggggcggtcgcctccgaaagggtatcggaggcgctcaaaggtcttctcagaatggacggaaaccattcgcagagtgcaaaggcagaagaaggcttgactgtgacaccgacgggtggagcaggtacgaaagtaggacttagtgatccggtggtataacgtgggattgccatcgctcaacggataaaagctaccctggggataacaggcttatcactcccaagagttcacatcgacggagtggtttggcacctcgatgtcggctcatcgcatcctggagctgtagcaggttccaagggttgggctgttcgcccattaaagcggtacgcgagctgggttcagaacgtcgtgagacagttcggtccctatccggcgcaggcggaggaaatttgataggagctgtccttagtacgagaggaccgggatggacggaccactggtggatctgttgtattaccaaatgcatagcagagtagccaagtctggaagggataaacgctgaaggcatctaagcgtgaagcccccctaaagataagatttcccatagagtaatctagtaagaccccttgaagacgacgaggtagatagggcagaggtggaagtacggcaacgtatggagctgactgttactaatcggtcgaggctttaaccaaagaaggtaaggaagatgtttgatgaaaggttctgtatgtagttttgaaggtacatagattattttgtaaagatttggcccggtggctcagccggttagagcgccgccctgtcacggcggaggtcgtgggttcgattcccatccgggtcgttttttcctttttaggaggatttataatataaatttgggatcatagctcagctgggagagcatctgccttacaagcagagggtcataggttcgagccctattggtcccatttttgtcagccgttgtggctcaattggcagagcagctgatttgtaatcagcaggttaccggttcaagtccggtcaacggctctcataaattatgttataaacgtaattttatgtttgagttttatgctgaaatggtataatatatatgtatatggtgggattcccgagtggccaaagggggcagactgtaaatctgttggcaacgccttcgaaggttcgaatccttctcccaccattttagcgcggggtggagcagtctggtagctcgtcgggctcataacccgaaggtcgttggttcaaatccggcccccgcaacttccattagcgttcagagcgtgcatagaaatatttatcaacagggccggatatttatattcggagctgttgataaatgtttctatataggcggtaacgccgtgatctcaaaagtatagcttttgagattttgtacgcggactaaagtaaaatcaatacccaagcccagatagctcagtcggtagagcagaggactgaaaatcctcgtgtcgctggttcgattccggctctgggcatctaaaagttctgatttttatcagggcttttttctttttcccaaaataccttgtcacactttaaaatgtcgtggaatatctacggtgtgtatgataaaataggataaaatgaggcttaataacaatttatgaaatatcctatatttgaaaaattaagacaattagataaagaagggatgtatccgttccatatgcctggtcacaaaaggcagaaacaggacattatgagagagggatctctgtttgcgcttgacactacagagatcagcggctttgacgatctgcatcatcccgaggggatgattaaagaatcaatggagtatgtccaacatatatatggaagtaaggaaagttattttctgatcaacagcaccaccggaggcattttagcttctgtggctgcgtcctgtcggctgggagataagattcttatcagcaggaactgccacaagtccgtatatcatgcaatttccatgcttggattaaggccggtttatttatatcccaaaatagagcagaatatttgtatggggattactaaaagccaggtgcaggacatactgggcagggaaaatggcgttaaagccgctgttatcgtttcccctacttatgaagggatcgtgtctgatatcaggcagattgctgaggttcttcatgaagaggggattcccttgatcgtggatgaggctcacggagcacattttgtatttcacagtggatttccggagagcgcggtatcccagggagcagatgcagtgatccagagtctgcataagacgctgccttcccttactcagaccggacttctgcacatatgcagttcccggataggcaccagggagattcagcaggctttatctacatttcagagcagcagcccgtcttatattttgatggccagtattgattactgtgtcaggaaatgtgctgacagcccggacttgtttgatgactatgttcggaatctaatggatatccgggccaggcttaaagctatgagacacctgaagctcttaaagacagatgatccgggaaaaatcgttgtttcgaccggcgatacaaagattaccggcaaagagctgtttcatattttgaggggtgagtatgggatagagttggagatgtccgaaatatcctatgtcactgccatgacgagtatttgtgatacaaaagaggcattggataaattgtgtgaggcatttctggaaacagatgaaagcctgcaccatgttcaaaatccgggactggctgttattcctgccactgagcaggttatgacaccttacgaggcaaagataagagggagaaagttggtgagtcctgccgaatcacttggagggatcagtgcggattttatatttttatatcctccgggcataccgctggcggtgccgggagagaagatttcaggagaaatagtgcagaaaattaatgagtaccaggaacagaagatgaatctgattggcctgtcggaaggccggatatacatagtggatgaaagggtttgagatgggaatatttataacgatggaagggccggacggtgccgggaaatctacacagattgatttattaagagtctacttattgcagaaggggtatgatataatagtatgcagggaaccaggaggtacggttataagcgaagcgatccgtgaagtgatcctcaacagggattataaaaacatgggacatatgacagaacttcttttatacgctgcggccagggcccagttagtggaggaagtcatacagcctgctctggaccagggaaaagtagtcatctgtgaccgcttcatagaatcttcggccgtatatcagggaattgcaaggggactgggtgttgatctggtatatgaagtaaaccggtttgcagtgggaaatgctatgccggatataacgatcctgcttgatgtggatgcagagaccggcatcggaagaaagaaacagcaggcagagctggaccgtatggaatcagaaaagctggaatttcacaggaaagtggtggaaggatacaggctgttagccgaaagagataaaaacaggatggttaagatcgacgggagaaactccattgaggaaattcaccgtcagataaaagtagcagttgatgatgccctgacaagagagacaaaccggatgtaatgtaaaaagacgaaccggcagggtattgatttcatagggatggaagaggatgagatgaagagttttgataacgtggttggacataagaagatcatacagcattttgaagaagccattcagaccggacagatttcgcatgcatatttactgaatggagaagacggatcgggaaagatgacattggcaaaagcctttgcaaaagctctgctctgtgagacacacgaaggctgcggtcaatgtaccccgtgccgccaggcggatacgggaaaccatccggatctgatctatataacacatgaaaaatacgagatccgcgtggatgagatcagacaggggattaatgagaccatagacattaagccgtacagcagcaattacaaaatatacattgtggatgatgcagaccgtatgaatgtaggggctcagaacgcactgttaaagacattggaagagccgccggagtatgcagtgatcctgctgctgacaaacaacaaagaccgtctgctggagactatattatccagatgtgtatgtatgtctctgggaaccgtcccggaagatcagatcagggcttacctgaaggaacacatacaggcagatgaggatatgatcgaatttgcagtatcgttttcactgggcaaccttggaaaggccatccatgtagctacgaccaaagagttccacgagatgctgaacgaggcgctgggaatgcttggttatatacatcatatggagcttcatgagatgatttcttacttaaagacattgacaaaatataaagaacagatttatgattttcttgatattatgacagactggtacagagacatgctgatcctcaagacgacgggatctgtgaatcttctgattttcaaggacaagtaccgccagcttaaagagcaggaaatctatattacatttgagggccttacccatatcatggacgagattcagaaggccagagtacgcttgaatgcgaacgtgaattttgaagtgacgatggagatgttgcttcttacgatgaaggagaatggaaagatatggtagaagtagttggggtgcggttccgcactgccgggaaagtatatttttttgatccaaagaagtttgatataaagcagggagatcatgtgattgtggaaactgcccgcggtgtggaatacggcagggtcgtaacggacaagaagaaagtggacaaggaagccgtctctgacgagttaaaaccggttctgaggatcgcaaccagggaagataaagatgcagcactggaaaatctcaagaaagagaaggaagctttctccatctgttcacagaagatccgggaacataaactggagatgaaactggtagctaccgagtatacgtttgacaacaataaagtcctgttttactttaccgcagacgggcgtgtggatttccgtgaattggtgaaagacctggcatcaatcttcagaacaagaattgaactgcgccagatcggtgtgagagatgaggcaaagatgctcggcgggattggaatctgcggacgggcactgtgctgcagttcttatctgtcggaattcatcccggtctccatcaagatggcaaaggaacagagtctgtctctaaatcctaccaagatttccggggtctgcggacgcctgatgtgctgtctgaaaaatgaacaggaaacatacgaatacctgaacaagaaactgccgagcatcggagacgcagtgaaaacagcggacggacggaccggcgaagtgcagcgggtcaatattctcagacagaatgtgaagctgatcgtagaagatgacaacggtgataaggaaattgtggagtacaggctggatgatttgaactatcatccgaaaaacgggagaaaaagacggggaaagggcagtcaaaagaatcatgagaattaaacctggagacggagagcgcttggatgatctgggtataaagggatatcagatcatccagaaaaaagacggcttttgttttggtatggacgcggttttgctgtcctcttttgtaaaagtgaagaaaaacggaaatgtgctggaccttggtacaggaacggggattcttccgatcctcatggaagcaaagacacccgggagacattttaccgggctggaaatccagagtgagatggccgagatggcagcaagaagtgctgcattaaacgggctggaagaaaagatagagatcgtagaaggcgatattacaaaggcttctgcgattttttcacatgacagctttgacgtcattacttcaaatccgccttatatggtggatgatcatggcttcaagaatccaaatgatgcaaaggccatcgcaaggcatgagatcctgtgcagattccgggatatttccggtgctgccagagtccttttaaaacacagcggaagcctgtttttggttcacagaagctaccgtctttctgagatccttaactgtttgatcaatgacggcctggagcccaaaagaatccggtttgtctatccttacagggaaaaagaatccaatatttttttgctggaagcagtaaaaggagggaagtccaggatgaaggtcgaaccgcctttgatcatctatgaaaagcctgggcagtataccgaagaaatttataaaatttatggatggaaacctgaggaggtttaaatggcagggaaattatatttatgcgcaactcccatcggcaatctggaggacattacattccggacactggaaacgttaaaggtcgtagatttgatcgctgcggaagacacacggcacagcattaagcttttaaatcactttgatattaagacaaagatgacgagctatcacgagtacaaccgcgtggaaaaagcccgttatcttgtaaagcttctggaggatggtaaaaacattgcactgattacggatgcgggcactccgggcatttcagatccgggagaagaactggtgagacagtgtcatgaaaacggcattcaggtaacgtccctgccgggtgcatgtgccctgatcaatgggctggttatttcaggacagccgaccaggagattctgttttgaagcatttctgccgccagataaaaaagaacgcgccatgatcttagaacagctgaaggacgaaacacggacgatcattttgtatgaggctcctcacaggcttttaaagactttggaggaactttacagcacaatggggaacaggaaaatgacagtctgcagggaactgacaaagaaacatgagacggtgtttgtctctgagatgagagaggtgatctcctattataccgaacatccggcaaagggtgagtgtgttctgatcattcatgggaaaacattagaggaactgaaaaaggaaagccaggagcagtttcaggaacttgatctgatggagcatatgcaacgctatttagggaaaggcctctcacaaaaagaggcaatgaagttggtggccaaagaccgcggagtaggcaaaagagacatctatcaggaacttctccggtataaagaataaaaaaacatcaaaaaaggacatatcattcagcatatgtccttttattatatcccactgctttattctgcaacatttaaaccagcaagtttcgccagttcaatgatagaactctttgaaactttcttgcctttgtactcaacgagatcatccatttcgccagtaaagatgtccgctggattgtacttcttcaatatgatcgtatcttcgtcaacgaagatttcaaggggatccctctcattcacatccagattacgtcttaactcaattggtaaagtaatacgtcccagctcatcaagcttccttacaatacctgtactcttcatattcgcttccctccttgcaaattagtaaactactatacctaacaatatcatacctcagaaagcttgtcaaatccgggctttgaagcatattcttgtgaaggagagaataggatacattaaggacgaaaaaggagtttcactttgatcaattatatatggagtatcttaattttagcaggtatattaataggaagtattaacggcaatctgaatgccgtatcagatacgattttggactcttctaaggaagctgtacagctctgtatcctgatgtttggggtagtaggggtatggtccgggattatgaatgtagcggtctctttaggccttgtaaaaaagcttgagagactcatagcgccatttttgaagttcctgtttccgagattaagggataaggaagcaaaggaatatatcagcacgaatattgtagccaatctcctggggcttggatgggccgcaacaccatcagggatcaaggcaatgaaggccctggacaggatcaatccgcacaagggtgtcgccaccagggaaatgtgcatgtttttgatcctcaatatttcttctttacagctgatccctgtcaatatcatcgtattccgaagtcagtacggaagcgtgaatccgacagcggttgtggcgccggcaattattgcgactttctgttccaccatcgtagggattctttttgcaaagatcatcgagaaatttcagaaaagcatttgatttttagagacaatttgtattataatgaaaatatagtttagctagaaccaaataaataggcaaaactgccgaaaggcagtgacgcaaagctaaaggggctatatcgtatgaggagtacgatcgtgccagccagctgcctcataaattattatttatgtgtagattgagaatccgtcggatactcagtcttttttgtttcataggattagggtgtcaaaagacacattaataaatatctgattttgtttgtaccttgaaaatttaacacgaattggtttgagaatattaaatttagaacaatcaacagaaggtgagcttgatgttttgagtattaattatgctatctctttttcagaggcacaataaaccaagctattttcataatccaatagcttttgaaaattcaaagctgcgactttgaatccgaaatgcagacgagtctgttttttgccatgtgttgggattttgtcggcatgatattttctgcgaagcagtgaaggtaatgattctactccatttcggaaatgtgcatactgcttgaattcttctgttttcataaaacgaagttgttttgctcgattgactgctttccaagacagttcttttaacgcattgttttggcgtaaacgtggtttgcattctgccaggtatggacagtctgcacagtcacattttttaaacaacgcatcacaacggtcattgtgctcatcatagcggaactgatatggctttttatgattgatacactccaacagttcatgcccatcttcgctaaaaataaactctgcaaaaatatcagccggttttctcccggtaaaattcgtagtgataagtcggattctatgtttagcagcttcggcaacattaacctcactgccgtaagcaccatcggcaatcagtaatacttcctgtttatatatcggttccttggctaaatgatccttcatgaattggctgtctccgtatatgttttgttcgtacgcataatcggtgatcaggcttttgttttcccctacggtttctgtgagatttgctacgtatcctaaatgtttacctcctgctttttttcggaaagtggcttccggatcagatggatttaacaacacttttgatggatcctctttttcctttttttcacgcaacctgcgggtcccatcgtcattgaagatggtttgttctttgagtaaacgtatcaacagctgatattcgctggtatcatcaaaatctccttcgcagagttccagaagtttttcggcatcatgcattacaacaattgttctttcgttagcatctagtttacgctggtgatagataaacgcattgtaatcatccttttccacataatgtttttgcttttctggaagagtaacccctctgctaaccataacttttgctaaatttgcagtacaagtatagaaaagctctaatagtgaaagattccggatatttgccgcgatcatcatactgtccattctctgcatagaaggggtaagccccataaattcagatatttcttttgataaagaggtaacacatatatgaatcaggtcaataccggtttctgtttcataagcaaggcatcttgcacgaaatctactcagagttctgtcgctcaagggctgttcttcaaaactagtagtatgaagagcatgctgataccgtatatcaaacattagagcctgaacaagttcatcatcactatcaccaagtgcttctttgagaatcaatgcaccaacgatgacatttacgggagtatttggacgagaagctttactactatacaatacagaaaatatatcttcgtttatggcaggaaaaatcctatccgaaaaagtctttgcccatgatttttcaagaaacctacgttctctttctgtcaggttaaatgtgctgtcagtcaacgacatttgttgactattatttgatacaaaagccatgcgaatcacctcgatatttgatatttatattttaccaaatgttcggatgaattgatatatcgtgttaaattttcaaggtacaaatttatatcaaaggtcaatgaccttttgacaccctaatcttcataggaaagttctacgaccttccctatgaaataaaaacgctccgcgggttgtgcacagatgcgtaaggaaattatttgcctgcggcaaattgcatctggcacccaaagttgtcaagcccctcaaagagtgagggaggggttggggtgttgaaatggacttgcccactttgttctttcaaataataaatgggggtattaaaaatgagcaaaaaggtaagaaaaagtcttgcagtccttgcggcttttgtgctgatgatatcatttatcgcaggaaacgatgcgttcaccaatgtctatgcacaggaagcaggaacagagactgcatcagaacagattacttctacaacagagcaaaagaccgttacagagagcaatacagaaaaaaacagccgtgaagtccgtaaaacaggcatcagagcctgcagtgacaaacggtgatttctccaaatacttaactaaatttgcatttacagaccatttaggaaatgcgttcacagaatctcatcctgtcaccaaagacagcaatgtgatcatcagatatgagtttaagattccgaacgtgttccatttagatggtcttagcggcgttgcgcagaagttgaataattaacaggcaggcgctgtggaggaagttccgaactggacagtaaataacaacgcaaccatcacaataaaatttccgaaaactttgacacagtctaatattgaaggatttggacaggagtatcggaccgactatgagccggaagtgacaaagaaaaatcctggagttacaaaaaaaggagccctgaacagagaagaccagaccatcacatggacggtcaacgccacaccggataagggagacaacaatctggaaggatacattctgacagatacatttgacaagaaacaagtctttgtaaaaggctctatggagttagacggaacaaagactgctgaccctgagctcattgacaatggatggaactataagttcggaaagatcagcaatggttcccacacgattacttataaaacaaagcttacagatgaattttttgaaaccgattataaatccagctatgctaaagatatgtctgccagtgcagccaatgctgtgacaattaagacaggggacggcaaaggcgaagcttcggcaaatgcttctgtacaggcagggaacttcctgtcacagtgacagataagcttccgcaaggaacctctctgatggaagcagaaggacagctgaccgtaaaatacggcggaaaaacggcggtgaaccttaagaaggcggctagcagcacacctgatgtaaatgaatacacatatgatgaaacaacaagagaatttaaagtaacgcttgatccaaagttcaacagtgattttgtatatgtaaattataagatctggctggatactcaggcggctgtaaaacaaggaagtgtaagaaatacggcagtcatgacggttggaaatcacgtaagcatttccgattatgaggattcaagctggggaattggatatcaggaaggaaagctgggactttcaaagtcaggagcttttgcaagagttggggatgataataccataaaatggacagtcactgtcaataacaatccaaccaaaacagtgaatggagacattcaatttaaagatgtgcttccggaagggcttgaatacattgccggatcttttaatgctaactataagggcaagaatgaaaaaaatgtgcaggtaaacggaaacgaattaatttttaccataaaggatcttggaaaaaacaaatgtacgatcacatatacaaccaggattaagggcggagcccttcagttcactcagaatgcaaatgggagctcaccggcaatttcttttaaaaatcatgtgtatctcgaatgggacggaaacaaacaggacattacaggaacaggttccgtaaatatccagacttttgttcccaagaagggaagctataacagcagcaaagatgaattcaattggacgatctggctcaggtcaaaagacgtttatatccataacatggttgtcacggagaagctgccggaaggccacagactcgtagagggaagcctcaaatacggaaagacagttcttggaacagagaagagcgcagaacagccttactatgaggtaagcggtaacaatattattatttattttccggaacagatgcttccgaccgatcagaatgatctgaccctgagtaccgttactgatgagacaaaggttgagacaaaacccgaaaaggtaagtgcagttaatgaagtcagcgtacgggcagacgagtttaaaacggagctgacagcgaaagctgcagtaaatgtaaactatacgccggacgtagaaaagaccacttcttataaaaaaggaaattatgtagagtggaccgtaaacgtcaacaaaaaccatgcggtaattacaaaacagaaggctgagatcacagaccagcttcagtcgggactgacttacagagagggatctgtaaagctgatcgatgtgacggcaaacaataaactgatttccggaatggagacagattatgatgatgtttcaggcaagatcgtgtttacattcccggacggattggatttaactcatcagtttgaagtagtctttatcacagacgttacatctgccacaggaaatattaaaaacacagttacctttgatgcgagtgccaaagagaccaaggcaaccagcggcagtgttccattgatcttaagcggaatgaacagcggcctgacaggtgacaacattcgttttatcttaaataaaacagatgcagaagataatgctccgctggaaaatgtagaattccagctttatgaccataacagaaatgaagttggaagtgttttaaaaacggataaaaagggacgaattgcgtttgatgccgggctgaaatacggcaacacctattatcgatgattatgtactggacgcggcggaacacaaattagtgatcggagagaaagagtctgacgtagttcaggttccgttctccttaaaaaggcgagcagtgaagatgctcaggctcttgaaggagtagaattcagcctttacaaagcagacggagaattagtggctcaggggcttaagaccgatgcacaggggcagatcagatttgattatctggggcttggaacctattatttccaggaaactaaagcgccggaaggctacaatctggatgcagccacaaagaaagcgctgggggggagctgagcttcagatcattaagattcaggaagacggatcagaattaatcgttgaggagtggacatcaaaagaagaggcacacgtggtcacaggaaagcttgtacctggagaagaatatgttctaaaggagacagaagccccgtttggctatgaacttgcagaagatgtgaagcttccagtaaatcagtgacagaatcaagggtttccagaaccggagacagttcacatacagctgtttacgctatagtggctgtgtgcgcggcaggtgccgttctgctgcttctcaggaaaaaacataggaagtaaataagaataatctaaggataccagtgaagcacgatttgtgtctggtatccttttctgtatcataatgagttctttcaatattacttgtttttggtatataggacgaggatgcatatatatattataatataaagtaataaggcgggtgtgactgtgattgtttcgctgtccggcattattatccctttaattttattcattatactcttgtatggaatgatctcaaaaaaggaaatgtatcagccgtttctggaaggagtccaggatggatttaaggtagtcatggaaattgcccctaccctgatcgcactgtttttagctgtgcagattttcaggacgtccggagcgctggagcttcttgtatctgtattgagtccggtgggacagcttttaaagattcctaaggacgtgcttccggtgatctttgcaaagctgttttcctcatcggcagctacggggttccttttggatatttttaagaactttggccctgactcagctcagggtgtcatgtcatcaattattttaagttccaccgagacatgtttttatacaatgtctatctatttctcgaccgtacatatcaaaaagaccagatacaccctggcaggtgcccttctggcaaccttcgcaggggtaatggcgagtgtatttctcaccgggatgcattaaaaaacgggagccggaaatcattccagctcccgttttttaattgtttttcgtctcatagtaatcccggaagtattccatgatccgtatcagaaggcattcttcatcttcgtctaaacgggaaagtacatcttccagcatcgcgcggtgaaactgcctgtgatggtcataggcttccttccctttgtcagaaagcgatatatagacgattctgcggtcctgctccccgcgcctgcgtatcacatagccttttttcaaaaggctgtttatggcgatggtcagtgttcctaccgtgatgttcagggcttttgcgatggaagacatattcttcggactgccggttccgatcgcgtcgattatatgcagttctttgttggaaatgtccttgaactcctctgtgatgaccgctttttcctcctggtaagatatttcatggaaaaggtttaccacaatgtcgttcagctgctctttggtcacggtaagaattcacctcacttttattttacatggttgtgcgcttcgctgatcactttagccagagcttcttttgcctcagtaggaagggcattgtatcctccgtcttctgtatctttctcaaagatgaaattcaggcgttccgtcattcttgctttcagtgtattgacataggtctcatcgtcgaaatcagggacatatccttcaacttcgatcgtttccatgttgctgaacggtccccagggctttaactgggcgttgccctccacaacctgttccaatacagacaatgtaacaccaggagtgatatccttgcccataaagtcgccggtatttaagatataacattctacatggcggtcctttacaagagaacggaacttgttgtaatcatccacaagaggataagtacggaacgggtttgcatatggttctacgaccagacggttcgggtctactccaggtgccaggcgttctgcgttggtacgctttgtggcaagggtggcacccatgactgcagccaaatgtgaaccgttgactttgatgatcggcggaatggtaggatctttcataatccagaaaataccgttaaccggagattcaatcttgtctacacggtttggtgaccagagtttagacttgattgcccgaccgttgccgtttcggatgtcttcagtgacaaggacaacattgcccttgtcatctctcgttgcagaacagttctgtgccgtgaggagatacctgttgtcttcgcacccggtggggtagtcggaggtcttgtcaaaataagtaggctccatggcgatggaagaaccggtttcggtgttgatgataaaggcatcgtcgtggaggacggtgatatcgtatttattattgtgtacggcgtgggtcagtgttgattttcctgatccggacagaccaaagaaagatgcaacatagctgtggttcggacttaaacggtattccttctgtccgccgtggcaggaagcatagccatttctgttggcaatcgcccaggcgatggtaagagtaccttttttatgttctccaaaataacgcattccaagcaaagctgcgcagttggtctgggtgttgaagtaagtaagtccgagcggatgttctgggtggctccactgaggatcggagaaaatataaatatcagactcgctgccgatggcacgggaccttttatacatcttgttatattcatcagactcatactggaaattaagcatccaggagtacaggatattttcctctccctccggaatcagaaggtgtgccttaaccataaattccgggtctaagccgatgtagacttctgcgtggtacatggtctttttgcgtgtatcgtagatcgcgtccatcacttttaagtccagatcgttggtatccacgttcggacttcccgcgatccttctggctgccgcacagcgtccggtgacggagccgtcattgaacagcaaaacttttgtgtcttttttcaggccgaactcttctccgcggtagaccggcatgtcggtgacaatggttcccggagaatttttagcaagctcatatgcctgcttcaggtttaccacctcaatgacgttgttgccgtaaaatgcggcctcaatgatggaacgggtctttgaaaaacccggttttccttttccaatctcgtcatgggcgtagcgtgcttttgttgacataatctttcctcctaaacttatgtgttttgcaggtacaaagatcgtacccggatttacaggttttcgtcgatgcgctgtctgagtatacgaaagctgttaggtccggcatctaatatgattttatgaaaaactttttcatcataagcattttcagatttctctttataataatcttttaattccatgaactccagataaccgatatagtagcataaataattggccggattctggatgacatagcggtaaagggctttcatgctggaggtactgatggttccgtactgctgcatatatttgactgcctcgtcaacactccagccttcatagttgacgcccatatccactctggcactcagagccatattgtacagataattgtccggcaaaagcttctttaaaggctcaagttcctgtttcatatcgaggtaactgtaagagtccatctccacgtaggtggcccagccttcgttgtatcccggataatccagaatataacgtatcggatgttcctttttgctgtggaaataagtggtctggtacagatgcccgggatagccctcatgagccagcgtcgggtacagggattcctggccggtctgtgccttgttgacataaatgacgtttttcttatagtcatcgatggcaggaatcatgtaaaaagccgggcttgagttttcttccagagaagaatggacatatttgatgtcacactctacttcggcggcagcaggatacttatcttttattttctgcttcagctgtgacaggatcttcgatggttttttgcttgaatatttattcagatctaaatctaaaaaagcatggtagatggagggatcttcttttatgatctctgtcatctctgtctgaaggtaaagaaggtgtgcttcggtggccttgatcatctgaggcacggtcttgtcagagccggttttataggaggcgagagcagaataataggacttcccatttttgaaatgggcatagccctgcctgttctttccgtttcctttcaggttcttcaaatcactgtacagattctcataggccggaatcacttcttctaagatcaggcggcggttttccttccggtaatttctcttctggttggtgctgaggtctgaaaccgaatcaatatttgtgttgaacacttcgatcatataattgtggtcggtggcccttgtaaaatcattgatttgttttaagacggcatcggcatccgcatctgacatgaaatatccccgtttgacctgttccttttcgtagcggatgaccgtgtcgaaataggaaccgactttggagagcagagaaaggtaggtttctacatcttccctggttcttaaagggtattcgcacaaagtcacgggaagctgggcctgggagccgagagtagggcttaaaaccgtctgaagataggggtaaggtgccagtttctgctggcgcttaaagtaatccatgagataatcataagactgcttctgactcttggagagtattttgtagttgaaactctcaagcctttttaactccttcttacattgggcttctgcctggtcaaggtcttttaagtcgatgttgcccagatcggcctttttggctttgatgccgtagtgttccggatgtgcaagggtataatgcagattgaccgtattggaattgacgtgttccttgaaaagctggttcaaataggagtcaaacttctgccggtccgatgctttgtctttggtggattctgattctttcgctgtggagggattcccggtgtccgatcctttggaacagccagtgaatgccaccatgacagccatggtaaatgcaagaaacttacgatatgtatatttatgcataagaatcctttctgaatagaatctcttagatactattatactattttttaaaggaaaaaaatagactatctttgcaagatgtactataataaaacacagtataatgcgaaaatggaggagaaacatgagcaaggaaccatattatataacaactgcgattacttatacatctggcaagcctcacatcgggaatacttatgagattatcttggcagacagtattgccagatataaaagaatggaaggctatgacgtattttttcagaccggaaccgacgagcacggacagaaggtagaattaaaagccgctgagaagggtgtgacgccgaaagagtttgtggacgacgtggcaggggagatcaaacggatctgggatctgatgaatacttcttacgataagtttatccgcacaacggacgcggaccacgaagctcaggtacagaagatttttaaaaagctctatgaacagggagatatttacaagggacactatgagggactttactgtaccccgtgcgaatccttctttacagaaagccagctggtggacggcaaatgtcccgactgcggacgggaagtacagccggccaaggaagaggcgtatttcctgaaactgagcaaatatgcggacaggctcattgactatatcaacgctcatccggaatttatccagccggagtccagaaaaaatgagatgatgaacaatttcctgcttccgggacttcaggacctgtgcgtgtccaggacttcttttaagtggggaatcccggtagattttgatgaaggacatgtagtatatgtatggctggacgccctgaccaactatataacagggattggatacgattgtgacggaaacagcacagatcagtttaaaaagctctggcctgctgatcttcatctgatcggaaaagatatcatccggttccatacgatttactggccgatcatcctgatggcccttgaccttccgcttccgaagcaggtttttggacacccatggcttttgcagggtgatggaaagatgagtaagtccaaaggaaatgttttgtatgcagatgatctggccgagatgttcagtgtggacgcagtgcgttactttgtcctccacgagatgccgtttgaacacgacggtgtgatctcatgggagctgatggttgagcgtatgaactctgatcttgctaacaccttaggcaatcttgtgaaccgcaccatttccatgtctaacaaatactttgacggagtcgtggaagataagggtgttgtggatgagtttgacgaccagctgaaagctgtggttaccggtgccagagataaggtccagaaaaagatggacgtgctcaaggtggcagatgccatgacagagatttttaatgtattcaagcgctgtaataagtatattgatgaaaccatgccgtgggtgctggcaaaggacgaggcaaagaaagatcgtctcgccacggtattatataacctggtggaaggtatcttaaccggagcggccctgctggagccatatatgcctgagactgtggagaagatcttaaaacagctgaatgcagaacccagaaggtttgaggatctgactacatttggtcattataaaagcggtacgaaagtgacagaaaagcctgagatcctttttgcgcggcttgatgaagaagaggtgctcaaacaggcggaagagctgatgaataagcaggcacaggcggcagcaggtcctgtgatcgacatagagccaaaagaggagatcacctttgacgaatttggtaagatgcagttccaggtaggtgagatcattgcctgcgaggaagtcaaaaagtccaagaagctgctttgctcccaggtgcgtgtgggaagcgaagtgaagcagatcgtttctgggatcaaggcctattataagccggaagagatggtcggcaaaaaagtcatggtcttagtaaacttaaagccagctaagcttgcaggagtgctttctgagggaatgctgctctgtgcagaaaatgaaaaaggagaactggctttggttgtgcctgaaaaagatatgccggcaggggcggagatctgctagaaatattgggaaaaggaccttatgtatatgtgatcctaaaaagttagaatttatagcgaagtggttatttactgcttcgctatttctttatgccatttggctagcaggtattttacaggacttaaccaataaagactcttcttgattcttttgtattattaaatttttaatatatcttctcaattacttttttcaattctgcattacggaaatctacatacccacagtccatgttaaaattattattttctgagattttcaattattgaagtatcattacagtttttgtcccttcgaatacttttaaatattagatttgttttcagtatatttctatagttttcgttttcatatttgagaattttgtaactagacagtgtatttcattgtatcaacagttctctataaatactgtttcagaaactcttataattagattcttccaattataatctactggttgttttaattattaagagtttattttcctattggtctcagaagtatcaggtctagaaatttagaaaccaatgatctatttagaaatggatggataatttttaattccaatggataaagcttatctatgttcatcgagcttattcaacaacgtgaaaaataactatagtattttcttatcgaataactaaaactctttcaaaatgtttaaacaaaatttttgtgtttagaattttatgaaagcatactagattggaaataaatgattaaaggggatatttataaaattgtaataatgccaaataataatttggtttggttttaattataaaataaaacataaagtatatgaaaaagaaaaaattgacaaaaattataaaaaatattataattaaagtaaaaaaataaaattataagatttatgtagaatattgcatgaattatatgtattttatattaaatttataaatagaaacatattttgtagtattaacaaaaaatagatggtctatattttagtccattgaatgaatggagtgaaaataatgagtagtaaaataaaatatggttttttaggaatgatcattagtggaagtgtattatctttagaattatatggcttagattttttgttttctattaaacttttatctcaaggagaagtctctgtaacatcagtggtagatttaataacactttttcctgttaatgttgcatttgtaataagtgttgctatttttttaacctctttgttaattttaataagtggattaaaaaaacaaaaaaattaatttgtgtaatttaatctaacgtaaattttgatataatgagttagtattattatacagaatcgggaagagagaaaagccaaatatgataattaagtttacagaagatttagagaatcagcttacagaagccgaacggcaggttatagagtatatcaatcaacatgaagatcagtttttaaagctgacgatcactgaactcgccgaaaagagtttcacctctcctccgactgtctcaagggctgtcaggaagtgtggttataacggtctctcggagctgcgctataaactttctgcaaagatagaagatatggtggagggagagattgtcaacgaaatttttcagaagtctgtcacagagtgcatgaaaaccatcgaaatactgaaagcggagacgatcctcaaggtagtacgttttattaagacggcgcggaagatttatatcattgcaagaggttctaccgcatggattgcgaaagatgtggaactgcagcttcagctgcttgggtataatgcatatatgctgtcagattcagaggttatgaaaaagtcggataaactgttcaggcagggtgacctgatcattattttttctataaagaacagtacgccggagctgctgttgactgcccagaatgcgaagaaggtaggtgcaaatgtggtgacctgctgctgcctgccaaagacagatttagaagattattcagacttgtctgtcctgggatataaccagagaaacaagaccatcgaggactttgatatcgtatccaggcttccattgcagatcattgcaagaacgctgattgattacttgaatctttgaggatggactaaaatgactgttgacaataattactaaaaagggtatcataaaagcagtaagaaaatagaagtatgtccactgtgacagaaaaacccccggagaggactggtctccgggggtttttattaactgtcttttcttctatgatccagccatttatggatgtagtaattcactatagatgatatgactgacataagaaaacgaagtatgtattccactgtgccacctcctttcagctggaaagaatcgacagaaatttcattatatattttattttttgatatgtatatataaattgtaaaaaagtaaataaatagataataaaaaagagtgtgaaaagggaaatcctgggtttccacactctttttttatgcaaaaacattcatttctcctatatttcaactgatatacatcagcagagccagccttaacaagaaaacattttcagtcctgccctgttatgatggatttataaaagaaaaggaggaacggcaatggttggaattttgattgcagcccatggaggatttgcagaaggactgttaagcgcggtggaactgatcgctggagaacaaaaccaggttaagaccatcggactgtatcacggtgacggaatagatgagcttgagcaaaaaatcaggacggcagtaaaagagctggaggatggggacggagtgctgggatttgtggatatcttaggcgggagtccatccaatatggtgatgaaatgcatggcggacacaaagaatcttaaagcgatcgcaggagtcagcatgggaatggtggtacaggctgtgatgatgagagatcaatgcggcttagatgagctggctgacctatgtgaggaagcaggaaatcagccggtggttcttttgcacaagcagtatgaggaaatgctggatgacatagaaatggatgaaatttaggaggaatagaaatgcagggagttgtattgacaaggattgatgacaggctgatccacggacaggtgatgacatcgtggctgaactttacaagtgccaacaaaattatggtgattgatgaccaaacagcggctgatccgttcatgaagaccgtattaaaaaatgctgttcccggaaatgtaggtcttggagtatttacagtacagaaggcagtggcaaggcttaaaaaaggatttaagcctgatgataaagttattattctggtcaagtatcctaaaacagttttaatgttaatcaagcggggaatccagtttggacacttaaatatcggcggtatgggagcaggcagcgggcgggagaaattttataaaaacatttcagcctcagaagaagaacgggagattctaaagaagattgttgacagcgggtgccgtacagaaatccagattatagcggaagatgcaaaagttgatgtagcaaagttattatgacattttctgtgttgaaaaaagaggtaagactctcgtaaatattaagaaaaagaaaggtggaaaaattatgagtatttcagttgttcaggcggttctcatcggaatcgtgtattaccttggaatcaatggaacaccgtggctgacttgtctgggaagcacaatcattcaaaagccgctggtatctggtgtcatagtgggatttattctcggagatccggttcagggtgccatcataggcgcggcaatacagcttccattcatcgcttatatttcagcaggaggggcacctcccactgatcccggtctggcaggtacactgggaacggctctggccatggcagcaggagtgaaaccgacagcagctatcgcactggcagtacctattggtcttttgggaacaatcatctgggtcatccatatgacggtagatgtattctttgtacatatgatcgacaaggcggcagaagaaggaaatatgaaaaaggctaaatttctgcatattgtaccgcctcaagtttttgcttttgttatcggatgtataccggtagccctgggctgttactttgggtctgagatggttacaaacattatcaacgcgctgagcgggcggccgcttcaagcattggaagtcattggagggctgctaccggccatcggtatcgccatgaatctgagagcaatcagcaaaccgggaattctgttatggtatgtgcttggatttatcattgccgtttatttgaatctggatactatgccgattgccatcatcgcaggtatcgttgcttatatttataccggagtagtagctctggcagaggaaaagcagacggcagcagcaacagtcggtggttttgacgatgagcttgatgacgattttgaataagggaggggaatagaaatggcagaagataagaaaatccacttaagtaaaaaagacgtgctgaaggcattctggaaatggacctttttttcacacgcaaattataactatgaacgtctccaggccagcggagttcttcagtctatgtctcatcttccggagaaattatatccttgtaataaggaagaacagcagaagtttatggaacgccatatggcattttataatacagagcctcattttggaggaattatcaatggtatggtcgtggcaatggaagaggagcgcgccaacggtgccaatattactgatgacgccatcaacagtgtcaaaaccggcctcatggggcctatggcaggaataggggatactctgtggcagggaactcttcagcccattcttctggcagtgggtatcagtattgcctcagccggaaatgttatgggagcttttgcatttgcagctttaatggcaggcatcatgcttcccatcgcttactttatgtatatgaggggatataagacaggaaaaaccggagttgaggcaatcctcggcggaggtaaaatgaaacagctgatctcagcggcatccattatgggagctacggtgcttggatctttgacagcaaattacgtaactgccgaatcccatatgaacattaaggttggagctaccaagctggctcttcaggcagatgttctggataaattattaaaaggcatgatccctttgggaatcacattgctgaccttatatttattaaaaaataaaaaattgaaatctacctatgtaatgctgattcttgttatcattggcggggtattagggctggcaggtatcttaggctaagacaggaggaatgattgtgagcagcaaaatgaaaacagccgtatttacggataaaaagcaggtggaaattgaagagtgcaaaaggccttcggcatcaggaaataaggtcttgattaaagtcgatgcagcggcaatctgcacatgggagcagagggtttatacaggagtcaacaaagtagagttccctttcatcggaggacatgagattgcaggacatattgaagagatgggagacgaagtcaaccgggacgaatggagcgttggggataaggtggttgtaggggtaacacttccctgcagaagctgttattactgtaagaccggaaatgaacagagctgtgagcattttgaccacagtgcacatcttccgggccttccttatagaggcatgggcggattcagtgaatatcttctggtttctccagactgtttgtttaagtacagtaacgttactccggaagaagcgtgtatcattgagcctgtatcctgcgtggtgcacagtgtagagacagcacaggtaagactcggagatacagtgctggttattggctgcggtattatgggactgcttcacactgctgtctgtacaaaaagaggtgcgaaagtcattgtatctgacgtaaatgaagaaaggcttgaaatggctaaatcccttggagcaaaagccgttattaatccggcaaaggatgacttagaacagaaggtgaaagaactgactggaggcatcaaagcccaggtaatctttgacacgacaccgataccggcagttgtagaagatacgtttaagtgtgtcagcaatgcagggaaaattgtgctgtacagttctattcatccggcagaaccgattccgtttgatccaaactgggtacatggaaaatctgtgcagattcttggaacagctaattccaacgacagagatttcatgagagcggcccagatggtatccgggggagttattgacttaaaaccgtttatcagtggagtctatccggcagaaaatataaaagatgctctggaatcgtcaataaaaggggataaattccgaaatattctcacattctaattatatatgaaaacacctgatagtttttctccacagaaaaacagatgttgaaaaggagacagcgattgccctcgctgtctctttattttcataggaaagttctacgaccttccctatgaaataaaaacgctccgcgggttgtgcacagatgcgtaaggaaattatttgcctgcggcaaattgcatctggcacgcaaagttgtcaagcccctcaaagagtgaggggttggggcgttgaagtgggcttgcccactttgttcttaataactgaagttaaccacttagcagtatgaattcatattttgaaaatattgtttagctgcttccagagagatttccatgtcaaaaaagcaggagccccgctgttttttattgtttgttttatttttgaagcttactgttgagaaaactttttctatttcagtttcttataattaatgtatcaagataatcaataaaggaggcagtttatgaaactattattggatacagcaaatgtagcagaaattaaagaagcggcagggtattatcctgtctgtggagtgacaacgaatccatcaatcatctccagagaagaattagatttttttgatactttaaaaaaaatcagaagcattatagaagaagatcagatgctgcatgctcaggtaacggctcataaggcagaaggtatgatagaggaagcaaagcggatgaaggatgagctgggtaaaaatttctatgtgaaaattccagcaacaaaagaaggaataaaggcgattatggaattaaaatccagagaatttcaagtgacagcgacagcggttgtgtcggctaagcagggactcatagcggctatggcaggtgcagactttgttgccccttatgtaaataggattgatcatcatgggggagatgggatcaaaacggccgcagatctgacaaaggtcttcagggaacatcatctatctgccaaaatattggctgcatcttttaaaaatacgaagcaggtttttgatattgctttgagcgggagctacagtgctaccgtatctcttcagattatggaagatatgttaaaacatccgctcacggatacaagtctggagacatttgattctgactggaaggcagcctatggagaaaaacacattacagatttttagtaattgagaaggaaggagaaaaaacatgagactgaaagggaagacagccgcagttactggagcggggagcggaattggaaaagcatgcgctttaaggctggcacaagagggagctaatgtgctggctattgatctggacggagcatcagcggagaagacggcagaacaaattcggaaagcaggaggcacggcagatgcggcgccggcagatatatcagagaaagaagcagtcatggcagtagcggagaaagcggaaaaatgtttcaggcccttggatatctgggtcaactgtgcgggtatttccgtaatccagccatttttggcagaagacagtgaacaggtgtgggatcaaacaatgagggttaatttaaaaggtacatttctgtgctgtcaggcagcggtaaaaggaatgctggggcatggaggaagtattattaatttttcttctcagtcgggaaaaaagggaacaaatcaatacgcggcatactgtgcaagcaaatttggtatccgggggcttactcagtcgatagcaacagagtttgcagaggaaaatatacgggttaattgtatctgtcccggagttatcctgactcctatgtgggataaacaggtcaacgattatgctaaaaagaaacatataacaccggaagaagtaatgccgagattcaaggaaaatattcccctcggaagactttgtacttaccaggatgttaccaatctggtcttgtttcttgcatcggaagattctgaatatatgaccgggcagtctttaaatctgactggaggagcatgtacctattaaaaaggacgaaaaacaatgaaattttttttagatactgcaaatgttgatgagatcagagaggcaaatgagatggggattatctgtggagtgaccaccaatccttccattattgccaaagaaggaagagattttaaagaagattatagagtagcatttggagaataattttgcttccttaggttctgcagtgttaacatagtagcaggaggtaaaatcttatgataattcgtttagaagaagatcagtggaagacacttacggatgccgaaaaatctgtaattacatatattaataacaatgaagaactgataccggaaaagtccattagcgagatggcagaagaaagctatacatctcccgctacagtctcccggactataagaaagagcggatttgacggcatctcagaactgcgttatagaatttctgctaagaatgaatttaatcaggagtcaatgatggtgaatgccatctttcaaaaatctatgctggaatgtcaaaagacaattgaaaatctgaaagtaccaacgattctggaagtggtaaaaagaattaaaagagcaaagaagatttatctcctggcaaggggagctacagtcctggtagcggaagagtttgaaatgcagcttcagctgctgggaaataatgtctggatcatgcgggattccgaacatatgaaaagatccaatctaatctttaaagaggatgatctggttataattttcacggtaaaaaacagtacgcctgagttaggaatggcggctaagtttgccaaagaaaacaaagccaatgtggtaagctgtacatgtcttccaagatcagagttaaatcaatattcagatgtgtatgtagtaggatatacgaagtatgattatgccattaaggaatttcttgttacttccaggctgccgctgcagattatatcaaggacaatcatagagtatctgacattatagagaaagagagaaaagttttgtagcttttctctctttcttgttccggaagcagaattgatggtacttaaatctttcccatcagcataatgatttgtaaatgctgcggtacattcgagtgaacttccatttcaatatatttgaaggaaaaatatttctgctaatctatagcgttaatatatattatccttagttctcatccggcataccgtaacggttagctccctgcaccccttgttttacaaataggataataaaataaattgcaacaatcagggccagaagtccgaatacaatggttgcaagtccaaacccgccggaagcagcttccgcattcatcagcaaggatgcggttgtcaaggttaagctgaccataaataaaatgatcggtatatatgcaagcaaaaccaaccaacctgaacggtctacgtcatgcagacggcgtacattcaatgacagtccggggataaaagtgatcagtgaccacagcgagttaacagcgtttgtatctaacatccttgcaagaaaaccgacaatgattgatacaataagctgtcccaggatagcccaccagaaattagaacgggatgtccttcctttaaaatcgaaatagcgtttccaatacgctttataagcgtttatcatagttaaatcctcctctttttcttttgtgtaataaatgatgaaattttcctttcctgaaatattatagacataaatctcattaatttcaagttctattgggaccggcggtattccagagggctaacaccataataacttttaaacttcttagaaaagtttccgctgtaccggtagcctgttctttttgcgatctgactgacagaaagatctgtggcagagagaaggccagccgccattgccattctcaggctgctggtatattccccgatggtcatatgataatgcttcacaaaaccagccttcagcttttgctggtttaaaaacaccttcttgctcagttcttcaatggtaggaggatgaactgcctgctccgtcaaaatatcgtgggccttctgaatggcctgtatatctgaggccgtaagcctgaagctgcgtttttttccaatttgtatcaacccgaaatcaagctggtgctgaaacatattatccttaggctttttgacttcctctgtcagaagtgcaagacattccaggatcttgctctccagaaaaagaggagacagacggccggagacagacaggctgttgagctggtggataacggaaatgacagtatggggcagatagcggtaagtatgattttgtttaaagtcactcagggaaagggaatcagggaaagtcacggaaacaatctcgtccaaaaaggctttgtggacggttatctctgtcccgtgaaaatgctgcccctgatgccaggcctgttttcctttcagatttttttctgccacaaaaaaagaagagggagtaaaggatgatacctgttgatttttcagctggaactttgtacttcccttatatacggttccaaatctcaaaagagattccggattgtcaaactggatctgaaaatccttaggtatcgtataatctgcgattccaagctcataataaccaggacgggaataaaataaaaaatacccgctttccggtgcagatacattttgatataaagtacagtgttcctggaaggacggctgaaatgaaagctggtacagcacttcctcccggaaagctttactggaggttatggtcatttcatggattcctttctgagttattttattgagtgtcagatttattcaaatggatgaataaaataaaaatcaattgaaaagcgggtcggggttaggtacaatacgttgcgaagtcgttaggtaaaactaactaaggatagtatacaggaagaaagggtaaaagtacaatgagaacgcaaaaattaaagttcattacagtcattttagttctggcagccctggcagcattgctggcgggatgctcaggaaaagaagatcagacagataaaaaagaggattcaaaaaccatcactgtgacagatgccaaaggaaaggttgaaatacctgcagatccaaagagaatcgttgatatcagcggaaacagtgatatactctcaattctcggttattctgtagtcggaaccgccaactcagatgcgtatgactatacaaagtttccatcctatttagaaaagaagctttccggtgctgagatcctgggctacagtatgcaggacaaaatggacgttgagaagattcttgcgttaaagcctgacctgattattatttcctcagttcaggaaaaaatgtatcagcagctttccaaagcggctcctacagttatgctgaagctggctcagacagactggaaagaagatgtgctcaaggtagccgatatcatgcagaaaaaagagaaagccgaagcatggcttgcagactataagaaaaaggcccgtgaaaagggaaaagaaatcaaaaaatcctacggaaagaataaaagctacctttccatccttgccagtggaggccaaatctttgtgtatgacaaggccgggataggaagtatcttatatgaagatatgggattaaaaagaccgaaaggactgccggagcagaaggatatcagccttccggtagtatcatatgaagggctggcgtccattgaggcagattatattcttgccatgggaaccaaagatgatatggcagctttaaagaaaaactctgtgtggaaagagcttcccgcagtgaagaagggacatgtggcagagcttcccgcaagcccttactttaaccagggatacagttccatcgggcgtctctcatttttggatgaagtgaacggtttaatggagaagatgaatgagtaaaagggtttctgtgtttgccgcagtttccgttatccttttgataactggagtgctgctggctgtttcccttggagcaaagaggctgccgtttgaaacggtggcctcggcgctctttaaaggcggggattcactggatataaaattgatcagggaagtcaggctgcctagggccatcgccgctgtattgacaggagggatgcttgccagtgcgggcgctgtgatgcagggggtgaccaggaatcccctggccgagccgtccatcatgggaatgacgcagggagcctccctggctgtggcagctgcaagtgtaataccggcagtatccggccttttcggtttgacagcatcggcccttattggtgcttttctcggcgggattcttgtgcttggattttgcctgcgaacgacaaatttaagtgtctcaaggcttctgctggcggggacagccctgggaaccttttttctatcgttatcctccctgatcgggattctgggaaaccgttcccaggagcttgcgttttgggtagcgggaggatttaagtccatcacatggggccatgtgtggcttttactatttgcaggagggatttctctgattctgtttttctttctggcaggcagcatcaacatcctgagccttggagatgaggcagccacaggactgggtgtccgtcccgaaaggatcaggctttggtcgattcttctgctgattccggtctgtgccgtctgtgtggccagcgcaggaaatatcgcctttgttggattggtcattccccacatgataagaaagatattcgacaatgactacagaagaatgataccgttgtctttcttaggcggaagtgtgctgatggtatgggcggacctggccgcgcgtctggcaaaccagccatatgagactccggtagggctgtttacctctatattaggtgtgccagtatttctgtggctgatcagaaaggagcaaagcagatgaaaaaaaggcagcgtacagcagtggccctggtggtgttcttgtttctggccgtgtttgtgggagccttaatgtatggaagctactccatgacggcaaaagatgttgtaatgacgcttttcggcaaaggggacggcatgcagaatatcgctgtacttgatctgcggctcccaagagcagtgacggcggttctaaccggagctgcattatctgtctcaggctgtattttgcagagtgtcaccaaaaatgatcttgcagagcccgggatcatcggtatcaatgcaggcgcggcacttgcggttgtgcttttgatttctgtacagagcaccagctattatacggcactgggctttggcactgttctgctcatgcccatagcggcagcggctggtgcttttataagctttctgtgtatttatcttctggccagggataatgggagtgtgaggcctgtaaaaatgatattggcaggtattggtgtcaacacaggggtcaatgccctgatcactctttatcagctgaacatgtcaaaaggagactataatcaggctctggcatggattggcggcagcctgtggggcagcagctggatgtatgttgccatgactgcgcccattattattgtgctgatccttattgtcttttacaaaaacagaacgctggatgtgatggatctgggagatgagctggctatgggattaggggttcaagtggagagggaaagaaaggttttccttgttctcgcagtctgtctggctgcctgtgccacttctgtggccgggaatatcgcgtttgccggactgatcggaccgcatttagcaaaacgtctcgtggggcctgtgcacaaaagacagattcctgcggcagcatgtttaagcagtattttagttttgggagcggatacacttgcgaggaatctgttttcaccgctggaaataccagcgggtatcatgatctccctgatcggagtgccatattttgtttatctcctgatgaaagaaaggtaagggtgtaaaatggaacaacaaaagattcaagtgagggatatcactgtcgcctatgagcagaccatcgtcataccaaagctgaatctgaatatccccggcgggaagatcaccatcgtagtcggcggcaatggatgcggaaagtctacactgatcaaatctgtggccgggatacttaagcccaaaaagggcgagatctttatcaatggtacggagattaaaaagcaggctcccagggagaccgcaaaacagatggcagttctgccccagagcccgcaggtaccggagggacttttagtaaaggaactggtggcatacgggcggttcccttatcagaaacctgtaggcggactgacagaacatgaccaccaggtgatccgctgggcgatggaggcaacaggcattctggcactgaaagaccgaagggcagattctctttcaggcggacagaggcagagggcctggattgccatggcgctcgcgcaggagacagaaattcttgtactggatgagccaaccacttatctggatatgtctcaccagctggaaatactctctctattaaaagaattaaaccaaaagaaccaaacaaccattgtcatggtgatccatgaaatcaatcatgcatccaggtttgcagaccatatcattggaatgaaggaggggcagatggtgtttgagggaacacctgcggatgtgataacagaacagaatttgaagacactttatggtatacgggctaagcttacactcagtgaggacggcacatatccggtctgcacggagtatgagctggaatgagcagacgggggaataaagcaaattttgttatcatagcggcggggcagatgatctctctgttcggcagtgccatccagcggttttgtatgtctctctatgtactggacctgaccgggagtccgggcatttttgctacgatcctttcaatttctatgcttccatatgttctgctcgcgccggtagccggaaatatcacagattacttcagcaaaaagaagatcatggtctgtacagacatcttcagcggcattgttataagctgctatgcggcttttttattttcaggacatgaccggccagctgtcatagctgtcacaatgatccttttgtcagctgcaagtactatatattcaccggcggtgacagcctccatccctctgtctgtttcagcaaaacagctttaccgggccaatggcattgtacagcagatcggatccgctgccaattttgcaggacctgtcattgcggggatgctgtatggttttctggggatccgttggatcgtcgttttaaatgcaatcagtttctttgtctcagcactgatggaaggatttctgcatctgccggaaaaaaagaacggctccagaaacaagctctcttttttgggcagtgtgaacgaaatgtatcaagggtttttgtacttaaaaaaatttcaatctatcatattaaagattattttctcttacggtctgtccaacctgttcattgttccggttttctccgtagctgcaccgcattttataaaaaatgtgctgggtctttcttcagaagtctatggatctgtggaggggatcacagtgcttgggatgatcacggggggagtactgatcagtgtgtttcccaagcgtttttccatggctgtgatccacagagtgctttacctgatgccggtttcgtttcttttcatgtgtctgaccggatttgcgtcccaaagcccgctcattaatatatgtgcttttggggcaggcggctttgctgtcatgctttcccttggcctgtccaatgtgatttcattgacttacatgcagcaggcagtccccggatctatgatcggaaagaccagtgcattttcaacggcagcggcgacagccacgatacctcccggacagtttttgttcggacagatattagaatcagggatttcggttcctgtgctgtttctttttgtatcagcggcaagccttgggactgcatattttgtgaaacaggcaataaaaaagaattaagaaattttaaaaaagttcttgcatattgtatttagttttgctatactattacttgtctgaaagatgcgggtgtagttcaatggtagaactccagccttccaagctgatcacgtgggttcgattcccatcacccgcttataagaattttgaaaaactgtctgtttttacaggcagtttttttctttcttccataggaaagttctatgaccttccctatgaaataaaaacgctccgcgggttgtgcacagatgcgtaaggaaattatttgcctgcggcaaattgcatctggcacgcaaagttgtcaagcccctcaaagagtgagggaggggttggggcgttgaagcgggcttgcccactttgttctattgatcatcattttaaccattggttaaattctcctgaggaaaaataaaaaaggattcaattgtaggtgtttcatcgggctgatacaatgaaaagagaaaaggagatgggcttatgaagatcaatgaaatgattcgggaactgcggataaaaaaaggtttaacccaggaacagatggcttccctgctggggatttccgcccctgcggtcaacaagtgggaaaaagcagtgtcctatccggatattacactgcttcctgcattggcacggttactggagacagacctgaatacccttctgtcctttaaagaagaaccaaccaaagaggaaatcacagattttctcaatgaactggcagcggatgtttccagcaacggagcggagcatgcatttcatatgggaatggaaaaagtacgggagtatccatcctgtgatccgttgatcttgaatgttgcggtcacactggaaggaattttgggtatttactccaaggaggactgtactgatttcaagaatgatattgaaaaactgtatgaacgggcagcccagagcactgatgcagaggtcagggaccgggcgcgttctctgctgatctttaagtatatagaccgcgaggaatatgacagagcagaaatattccttaaggagctgccggaggagtcaatgatggataagaaccagatccggacaaggctgtatatgaaacagaaacagtgggaggatgcgggccgtgtcctggaaagcagacttttaaagagattaaatgacatccaggttgcgctgatggatttgatgaccatagcctttgaagagaacaggcccaaagacgcagatgagatcgctgatatatcaaggcaggtagtgcgtttgtttgggttgtgggactatgggtcttactcagcgcagtttcagcttgcattcgcaaggaaagacattggtcagtgtatcaccatacttaaagatatgtttccggcgattcttaaaaaatgggagccgggccaatcaccgctgtacagatacacaggcagtaagtccagcacggaccattttggaaagtctatacttccaaagatcttaagcgaatttgaagaccctgaaaatgaggagtttcattttctacaggatgagccggaattcaggcagcttatcagcgcatggaaagaaaaaatatgacagaatctaaaaacaatcaaactgctgaaggaggtttcgcagtttgattgttttttcgtttaacatctgatattaactgtaaagcccgaaactcaacagataggctacaagtacagccgcaggtcctgtgacaagtctcgtaaagagcatggcgggtactccggcgctcacggtatcgtcctcagcttccgccagggtcagcgctacaggtacaaaatcacatcctacctgagagttgatggcaaacagtgcaggaagagaataagcgatgggaatggttcctttcccgatctctacaccgaggagtacacctaccacctgtgcgatcaccgcaccgggtccaaggaccggggacaggaacggaatggcacagaaaacggacagccccagaaggcctggaagacttccggccaatggtttaatggcatttgccaggagatcgccgatgccggtatagttgatgataccaaccatgatgctgcccttacggtataataatgacaaacagaaaaaaccttatttttcaaggggtttgagcgtttaccgttgtttattcaattccttttccagctttgaaagacaacaaaaaatcgtcgaataaaggaggctgttgaattaaagacaaaaaataaatatggttagcagtccggtggattttggggcttatatttgatgagggatgcggaaaacagcgtgtatctgatgcacgactgatttatctgccgagtgccccaatcgtcccgaataatatataatattcgggacaaaggaggtcggtgtaatggcaaacggatattccaaacaaatacaggggcggatagaaaatgctttagaaggaaccgtttttgtcaactcagattttgcggacattgctgatacagaaaccataagacggaatctgaacaggcttacacagacgggtacccttcggagaattttgaaaggtatttatgaaaaaccggaatacagcgaaatgctaaaagaatacgtggcggcagatccagaggcagtggcaaatgcgttggctcgtaattaccactggacgattgctccctgtgggaatacggcactgaatctgttagggctttctacacaggtaacagcggtctggtcctacatcagtgacggtccgtataaaacctatgagtggaactctacgaagattgaatttaagcatcggaccaacaaagagattacaggtctttcctatatgactgcgctcgttattcaggcattaaaaactctgggaaaaacaaatgtcacttccgaaaccattcaggcgcttagctcccgattgagtgaggaagacaaggccgccatgttaagagaagcgtcagaatctacggactgggtttacaatgcaatacgtaagattgccggggaggtacagcagaaatgaaaaatatcgcaaggttttcagacaacgataaacggatgctgttccgaaatacagcagataaaatgtgactacatgatgcgattgtggaaaaagatttctgggtttgttatacactggattatctgtttcaccattctccctggaaaaagtcgattacttttaagggtggtaccagcttgtcaaaggcatttcatctaatcagccgtttttccgaagatattgacctgatcttagactggagggtactggggtaccaaaaagaggaaccctgggagaaacatcaggttttctcctcctgaggatacgatcccggtaaatccttcggctagttttacaaatacattcataaattttgtcattcctttcgcttcgctcaaggcacaaacaagtgggactttgagcccggactcttatcattggcaataaaccatgtttattcagtcgcaggatgacagtcaatgttgctattcttttttattaaggtggtgatacttatgatgaagctgaaacactccatctgctgtgggcttgacgtccacaaaaatgttatcgttgctaccatcgtaactaccaacaaggacggaatatctgaatataagcagaaatctttttcaaccatcaactcgggtattcaaaagttccacaactggcttatcgagaatcattgttatcatgtttgtatggaatccacaagaaaatactggattcctatttttaattatctcgaaaacgacatggaagtctgtcttacccaccccaaatatgtcaaagccatcaaggggaagaagacggacaaaaaagattccaaatggattgccgacctttacaaatttgacctggttttggcaggacggcaacccaaatcatgtcttatctgttggaacataacgctgataccattgatgaaaaagccgtttgcaaacttataaaaaagggagccaaagccaagtcggatgaaatcattgaagccattaaagattataacattgaaacagaccaggctaaaaagctggaacttacccgcggacatctcgaatatctggatgatatgattacccaaaccgaagtggagttctatgtccgcataaaaccttattatgagtttgtcgagttcgtaagcacgatgccgggcatgacagaactaagttccaccatcgtccttgctgaaacgggtgtcaacatgggcatctttgacgatgccaaacaactttgttcctggtgtggtctttctcctgccaacaatgaatctgcaggcaagaaaaaatctgtccgtatcgcaaaagcaggcgattatctgaaaccgatggtggtacaatgcgcccttgccgcaatcaagagcaaaaaacagccttatttttcaatcaaatatggacggatcaaaaaacgcagaggccacaaaaaagcgatcattgccattgccaggatgatgatggtctgcatttaccatatggtgtctgaaaagaaacctttcacacctactgactatgaagaattgatggaatcacagaatcatgtagagcgtgttgtcttgaatgtaaccaaccatatgcttctcttttcaagatttacaaccatgaatttttaaccgtttccatctccaaaggattgattgatacctccaatctttccattgccggtgacggtatgcctgttgttacatctgcacgtaaacggaaacaccgtatctgtaagtgttccgaaaatggtatcacttcgtgtgattgcgaccgctacttttcccagcccgattgtgatgtcggatatgattcttctcgagactgtttttatcatggctacgatttatatatgctggttgcatccaactcggaaagtgatttgcctttcttcctgattttcatatcagcaaatggcttttggattctgctcatgataccatgccgtattatcggtattgtcgtgaaaacggcatacagccttttatcgacttaaataaaaaacgcggaatcagcatgaaatataaggatgattttaccattgcaaaagatggaattcctattcagaacttcagctgaacgttcgaataaacgtgagaaaatagactttcaattagaaagcggcaggcaccgctcaactaagatgtggtactgccgcctatatcacatccttatgctgcagcacttggatgcttgggatttgccctatgaatccaccctgagaaagttgattttagatgtggcataatcctttaactattatacaccatttttcaggcatagcgacagctatgtctattttctatgttcttttttctgttttaaataatatttacttttcaaagtacgtttctcggctgttgccgataataatcactcaggattccgagagattattacaaggtggtttgtcatgattctattttaccatgagcggagagaaaatttatataaatcaagcaagaaaatccagtaaaatcaaagggctttggcatttaacaaatgcctaataaaatattagaaaaggagagaacagatagaggaatctgtataaaaatatctgtatttttaggttttaataaaaaaaaataaaaaaaatgtgtataatcttgaataaatgtagaaaaaaaacctatacacatggtaaaattggtaatatagtatagcaaaaaatgtaaaaaaacctatacacattcgaaaaaacagcttatgtgtataaaaaatgggtggttttgcaaaattgaagtaaagtattgatttgagtatagtataggcagctggtaagtacagcgcagaataggagttgcatatgaaactgaataagaacaacaaagaacgagtatatgaattcattacaacatattcattagaatttgaacatgatgaatatccaagatttactacgaactttttgtcagggaagttaggtatgcaaaggaccaatttaagcagtatcttaaaccaattagttaatgaaggaaaattgatcaagcaaaaagggcgcccggtcatgtatcaatacattaacttatctgaagaagcagaagaggtttttaagagactgatcggctatgatcaatcattaaaagatgcagtagctgttgcgaaagcaacgatcctttatccaaaaggaaggtcaagtattcttataactgcagaacgaggatgtggagcacattattttgcagaaacggtttttcagtttgctgtgaaatccggcgtagttaaaaacaaagaagttttattaacatttgattgtaaagcttaccgagaaattccagactatcaacagaagctactttttggaactgaagatgaagttggaattctaaatcaatcagaaaatggaatgctgttgatcaatcatattgatttgcttccagcctatgaaaggaggcgtttactttctactaaagaaagaggaattttaatctgtcgcaccgattcaaatgcggatcaggaaatttatcattcattacaagaaaaaacagatttcgagatcaaacttcctatcttaaatgagagatccttggaagagagatttcaactggtacaaaggtttttatgtgatgaaattacaaatattggtaagaatctggaaatggatgcaaagatattatctgcattactcctatatgaatcagtagacaatgtgacaggattaaaaaaagatatccatacaggatgtgtaaactgttatgcacggaaaggaagttcaaaaaataaatttatcgaaatattgctttctgattttccaccgtatgtaaggaaagggcttatatatttgaaagtacataaggaagaactggataagttagtttcggaacagtatgtttacgcatttacacattctactatgctgaaaaagcaagcacaaaaggcagaagagaagaaagatatttatcagtctatcgatgatcgaaagaaaaagtataagaaacaggagattcaagaggaagagattgacgcatatgtatctgttgcattaaaagaggatttccaaaagtattataacgaattaagtgagaaaatttccaatcggacgatgctgaaaaatatcattgccaacaagatgattgaacatgtcgacatgtttttgaaaaaagcagaagagacgtttcaaataaaatatgacgagaagataatgtgtgccttgtgtctccatatgaattcagcattgattagaaatgaatcaaaacaaagggtatcaaatgaagaaatcacgcaaatgacagtttcctatccacaggaatatcaattggcaaaggaatttgttctagaaacagaaaaaatctttcacacaaaattgaatgtggatgagattatgtttgtgatgatgttcctcttagaagaaagagtcacaaagaaacagcaggttgttacattaattgcaatgcatggggattattcagcacaagcggttgttaaaacagtaaatgaactttctaatgaaaataatacatatgcttttaacttaccattagataagaacatgaaagaagcatatgaagacttcaagaaagagattattcgaattgatcaaggaaaaggaatcatcctaatctatgacatgggatctttgaggactatggcagaatccatagcagcggaaacgaatatcgacatcagatttgtagaatcaccaattacattaattggtgtagcatgtagcaacaaagcaagtgaagaaaaggcaatagatgatatttacggatatcttcaggaaaatttcaagacagcagcatacagtagaaattatgatggaagcaataaaattgtagtcatcatatcaaaatctgaaactgaagcagaaaaaattcaacgatttataaacgaaaatatgagctggaatgatataaaaatcagacgagttgtattaacaaatgaaggtcagctatatagcatgattgatggtatagcagatgaaggagaaattgttgggattgtaggagattatgatccactgctctatcaatatcagttcattgacgttaatcagctaatgaaatctgagaaaacaaacctaaatgactatatccaaacacagaatgaattggataagacgggaatcaccgaaacgtatgaatatttagagggaaattttccagaactggatatggccaaaatggaaatatatctggacgatttcatgcaacaagtagaatatctgttaaatgtaaaactggatgagaacaaaaaaatcggattgattattcacatcgtttgtttactagacagaatcagacagggatacacaccatccattagttttattgcatcaggtgtgattgacaagaacaaggaaatggttccagaagtgaaaaaaattctggaaccaatggaaaaagagtttaacgtatatattaatgagacggagattgcaacgatcattacgattatacgagaataggaggttattatgacaaaagacgaattaaacatgatcagctttgaaattgtttcttactcaggagatgctcgctctaaattattacttgcactagaaaaagcaaaaaatggagactttgaagaatgtgacagcttaattgaacaggcaaatgattgcttgaatgaagcacataactcacaaatggatgtcatgaaagaagaagcaaacggagaaacagttacaatgggatttatcatgacacacgcacaggatcatttaatgacatcattattattgaaggacatcattggaacattgattgacgtttatagaaaataaatgaagagaggatataagttatgaataaactgatacaatcaattgaaaaaatgaaaccgtattttgatgccatcgcaagaaacagatacttaaaagcgattaaggagggatttgtttccgcaatgccaatcgttttattctcaagtatctttatgctgttggcatatgtaccaaatatttttggattctattggagtaaaacagtagaagcattcctgttaaaaccatataactattctatgggaattttaggtctggtagtagcaggaacaacgtgttaccacttaacaaaatcgtttaaccgagatatgccagtagacaatcagatcaacgccatttctacaatgatgtgttctatgatcggattcatggtagtcgctgtagattctattaaagatggattcgcatcaggatatatgggatctaaaggattattaacagcattcttagtagcattctttacagccaacctttacaaattctttattaaaagaaatattacaattaaaatgccagatgcagttccaccaaatatctctcagacattcaaagatgttattccctttggagcatgcgtattattattaacaatctttgatttcttctttagaaaacagtttgatatgtgttttgcacaggcagtcattcaggtattccagccactgtttacagcagctgatggatatgttggattagcaatcatttatggagctatggcaatgttctggttcgtaggtattcagggaccagccatcgtagaaccagcagtagctgctatctactatgtaaatatcgcaaacaacttacagttatatcaggcaggagatcatgcagcaaatattttaacaccaggtgtacagcagttcgtagcaacttttggtggtactggagcaacattaatgatcactttgatgtttgcatttttagcaaaatcaaaagagttaagagctattggacgagcttcttccgttccagttttattcggagtaaatgagccaatcttattcggagcaccattaatcttaaacccagtattctttgtaccatttatttgtgcaccaatcttaaatgtatggttatttaagattttcgttgattatattggaatgaactcattcttatatatcttaccatggacaacaccaggtccattaggactattccttggttgtggtatggcgttaaaagcagcaattttagctattgcattactagtattagactttgtagtatactatccattctttaaagtttatgatcatgagaaatgtgaagaagaaaaagaaaaaggattagaagaagtaggttctgaagaacagcagattgaagttgatgcagatacattaaaatctaagagaatcttagtattatgtgctggtggtggaacatcaggattattagcaaatgctctgaagaaagctgcagaagagaaaaacattccattaatcgcagctgcaggagcttatggagcacatacagatatcatgcaggattatgatcttgtcgttttagcacctcaggtagcagctttctatgaaaatctgaagaaagatacagatcgtctaggaattaaatgtgtagcttgtgaaggaaaacagtacattgcactgacaagagatccagacgcagcaatcaaatttgtatttaagattttagaaggagataattaatatgagattaccaaaagattttatcatgggtggagcaactgcagcatatcagtgtgaaggtgaatcaaaagctcatggaaaaggacgagtagcctgggacgattatctggaaaaacagggctggttcagccctgatccagcaagtgatttttatcataaatatccagtggatttagacttatgtaaacagtttggcgtcaatggaatccgtatttctattgcatggtcaagaattttcccaacaggagagggagaagttaaccaggaaggtgtggatttctaccatgcaatgtttaagaaatgtagagaaaatggagtagagccatttatcacattacatcattttgatacaccaaatgaattacataaaaatggagatttcttaaatccacataccatcgattgctatgaaagatatgcaaaattctgttttgaagaattcaaagatgatatccgttattggtttacatttaatgaaatctggccagtatcatctggccagtacattacaggtacattcccaccaggagaaaaatatgatgtagttaaaactgttgaatccatgcataacatgatggttgcacatgcgagagcagtcattgcatttgaagaaggtggatatgaaggtcagattggtattatccattccctagaaacaaaatatccttatgatgagaaaaaaccgggagatgttttagcggcagaaagagaagatgcactgacaaatcagttcttactagatgcaacattcttaggatattattctgaaaatacattaaaacatattaatttcttatatgagttagaaaataaaacatttgctccaaaagaagaagatatggaattactgaaaaaagctgcagcatgtaatgattatcttggaattaactattatcagagtcactttgttcaggaatacaatggagaaagccagattcatcataatggtacaggggcaaaaggaacttctgtataccgattaaaaggaatcagcgagcatatgtttaaagaaggaattgatcgaacagactgggattggttaatttatccagaaggtttatatgaccagatcatgagaattaaaaaacagtatccaaattataaagcaatctatatcacagaaaatggaatgggatataaagatgatttcaaagatagtacagttgatgacgaaccacgtattgattacatcaaacgtcatttacagtggattgcaaaagcaattgaaggaggtgccaatgttaaaggatactttgtatggtccttaatggatatgttctcatggtccaatggatataataaacgttatggattgttctatatagattttgaaacacaggaacgttatcctaagaaatcagcatactggtacaaagaagtcagtgaaacaaaagaggtataaacgtatggtagattataaaggagtcatttttgatttcaatggaacattgttctttgataatgataaacatgtattagcctggaatgaaatttctagactgcttcgtggatgtgatatcacagatgaagaattgcatggaaaatttaatggaacaccaaacgatcagattatcaaatatatgacggatggaaaggcatcgttggaagaagtgaaagaatattcttcaaaaaaagaagcattttatcgtgaattttgcaaaaaagataaagaacatttccatttagtaaaaggctcagtagagtattttgaatggttaacaaaccataagtttccttacactatcgcaagtgcctcaattaaggaaaatattgactttttcagggagtctttccatttagataaatatattgatcctaaaaagctggtatacgatgatggaacatatgaaaataaaattcagatgtttttagatgcttcaaagaaaataggagttgagatgaaagacatcttagtaattgaagattctttctcaggaatcaaaaatgcatataaagcaggatgcggtaagattcttgtcgtatgcgaaaaagaaaaagaagaagaatataaaaatcttccaggagttcttggaacaatgcaggactttgaacatatttatgatttcttttaatctatcaatcaaacctgaagggtgagtcgttatgggaaaaaatatgataactgcagtgaatgtaatagaagaaagagaaaatggtattacattctttgaaatgaaaaacgatgaacttcaaatcagggtaacaaatcttggatgccatatcctgtccatctttgccaaggacagggatggcaaacaagaagatgttgttttaggatttgaggaaatcgaagattgtaaagaagacggaacttatatgggggctattgttggccgagttgcaaatcgaatcaaaggagcaagctttgaattaaatggaaaaacatataagctggcggtgaacaatggaccaaatcatttacatggtggagagattggatttgatcaaaaaatcttctgctatgaaatcattgaaaacggaatattattttcctgtatctccccagatatggaagaagggtatcctggaaccttagaattaaaagttaaatatttactgacaggtaataacttaacgatggagtatgaagcttggagtgatgaagatactctgtgcaatattacaaaccattcttattttaatttatctgcagggaaagaaaaaatttatgatcattacttgaagattaacgcagacaaaatagcatgtgttgatgaaaattgttgtacaacaggagaatttatggacgtaaaagatactccttttgattttcacgattatcataaaattggtgaaagaatcaatgatgattgtgagcaattaaaattagcatcaggctatgatcattcttttatggttaaaggagatgaaaatcagctttctttatatgatgaaaaatctggacgcaaattgaccgtatctacaacattgcctgccgtgcaaatttatacgggaaatttcttagatgaaggatgtaatggaaaacaaggaaaaccatatgaaaatcgtgacggtgtagcaattgaacctcagtttctcccagactccatacatattgaaaaggagcccaaagtgattctgcgaaagggagaaatttataaagctacaacaaaatatatttttcaagtagatgaacaatagatcattgttatttatttcctatgtgcgaccagaaaatataatgagattcagagtgttttctggtcattttttgatacccatatttaagatgaaagaaaaaattaatgatgtgattgttggatttgggcagaaaattgaaggaattggaatttcgtgcccaggaccacttgatttaattaatggaattatattagaaacaccaaatttaccaggatggaattattttcatctgacagaagcattgcaacaaattacaggaataaaagtacaattacaaaatgatgcaaatcttgcgggacttgctgaagcggtaatcggagcaggagcaggaaagagtcatgtacaatttctaacaatttcaacaggagttggagcaggattgtgtattgatggaaaaatctatcaaggggccaaaggatttgcacaggaagttgcaaattgtatcttatgggaagacggaccatctcatggggcattgaaaaatggatctattgagtcaatcgctagtggaacagcaattacaaccagagcccaaaatgttggattggaagttgcacatgctggagaagtttacaaattagaaaaagaaggaaatgaacttgcaaaacagattatggaagatgcatacgaatatttgtctaattttattgcgattttgtatggagtcttagatccagatttgtttgtattaagtggaagtgttgcattaaaaattccaggatttattgaagaaattgaaaaaagagcaaaagaaaaggtatttgatgcactgaaagataatgtaaaaattgtaccagctgcattaggagaagattgtggactgattggagcagcatgtttagcttttgaaggttaagatagtgtcaagtgatgtatgaaaaagctgagcataaaaaataggctcagatgaaccttgaaacctgtagatattgataacgttaagctctccgagggcttagggcgctgccctaagtacccgcaagggacttgtcccttgacctaatatcagactttgcccgaacccatcctcgccggaaggcaggaaaagggcgcagttgccccttttctgctaaacaggataatccgagaacccttatgtcaagcaactttcgcggcatatccttgtgcggtgcactgtggtattccacggtttgcgtgacaacggttccgctccttttagcagttccacctcatttaggactttatatcctgtgtgtttgtgaggacgaaggaaattgtagtaagcaacccatagagcaaggtcatagttggcgccgtcgatgttgtcaaagccgtttgtaggtctgtaagagaccttgtatgtacgattgagcctttcaatcatctgcttgtatggtcggaattcttttgacacttcatcgtcgttggtaagtccaattacctgagtgatgctgaacttaaatttatcaccaaactcatggaagaactgctgggcagctaatggataggcactgtatccatccgcaataaatttaaagtttttcggaagctcttttagatttcggaaagccattctcatcgcaaggatacagggaccaacaccgcgattatcagagatccggtatccaatgatggaacgttttgcagcatccataatgaaccagacgtaagctttaagaccacggattttgatataggtttcatcagccgtgaagacggattcggtgccataatcgtaatgatcgacaaagggtttgatgcaaagagctgcggatttacagtagttggaaatgctctgatgagagatagtgataccgtaaaggtcatggagcgcctgcttagttttcctgagagaaagtccaaacaggatgagccagaattcaggcagcttatcagcgcatggaaagaaaaaatatgacagaatctaaaaacaatcaaactgctgaaggaggtttcgcagtttgattgttttttcgtttaacatctgatattaactgtaaagcccgaaactcaacagataggctacaagtacagccgcaggtcctgtgacaagtctcgtaaagagcatggcgggtactccggcgctcacggtatcgtcctcagcttccgccagggtcagcgctacaggtacaaaatcacatcctacctgagagttgatggcaaacagtgcaggaagagaataagcgatgggaatggttcctttcccgatctctacaccgaggagtacacctaccacctgtgcgatcaccgcaccgggtccaaggaccggggacaggaacggaatggcacagaaaacggacaaccccagaaggcctggaagacttccggccaatggtttgatggcatttgccaggagatcgccgatgccggtatagttgatgataccaaccatgatgctgacgaagatcatgaacggcaaaatgtttttcaggacaatatccagagtgtcccggccggcctgataaaatacattcacaatacttccaatgccgcggcccatgctggtaataaagttaaaaaattgatttcctccaggggcgggggaggattcttttatctcagccggttctgggacagcctgcccggatacttcaggttcagatggaacagcctcaccgctttgggtaatacagtccagtgtagtgccagagacaaaattatcttctttgatatatttgctgagcggcccggacggggagatggggtggatatcgatggtctttactcccattttcggataaacaccgcaccggagtgtcccgccgcagtctaccactgcgatgatgatggtgtcgggttccactttattgttaaaggcatccactaccgggacaccaagcagcgacgcaattttttcagccagaggatgaatggagcctccggtgacagaagcgacgactttcctggtttctgtttcatagacagtcaatggtccgccccatccgctggagccctttgtgatcgttacagatggtttcattttgctgcacctcctttattttttgccatgatctttttcgtgaggaattcagtggcatttccacgaataaagataacgatgacgccggccagcaggtaacgcacggccaaaggcatagtggagtagccgagctttgtaatgccggctgcgataccggtccaaacaaacagttctccggcatttccgtgtggaaacaggccggtgatagggtgcgcaaaggagaaacaggcatcgataaaggcaggtttctggtcttcctccacgaaccgtcccatagtatagcacatgggattggtcaaaaagaaaagggagattacaggcagcagggtgtaacggagcaggcggaaccgggtcagttttttagagaaattcatgaccctgtcctctcctaccagagtgatgatggcattgatacaggtgagcaggatcagaagattgggaagaattccggtgatcaggcccatcaggttttctcctcctgcggatatgatcccggtaaatccttcggctagttttacaaatacattcataaatatatcctccttaacatggacagacagcagttttccgtttaccggcaatttgttctaaggctgaggcaaaagcggccttatcatttttccgtttcatcagggcagtgacagagcaggcaggacatccgatatagtcatttttttgattgaatctggaaaatacagtccgtcccttcatttcatagtaatctacaatctcatctgattcattgaccacgaccagcacgataacgcccgggcggaaggtcaggccggatttggcagttccgatggccagaagattcggtgtatggcggtaggccttcttcaggtcttcaatggactggtacattcgtttgatctgaaaccagccgaaggcggcctgagctgccattgtgaccatcagaatcccaagaacataagtaagcataaagcggttagcacctccttgatatgaatagattgacaagaagtttcacgtgaactcttaacatgtgttgatactatcctgccctcaaaatgaagtcaattcatctgattgttttggaacatattttacgattgcacaaaaataaatacaaaaaaccagagtgttccgtaacatttgttccatgtattcacttttgattgacgaaggtaaaggaaggtaattatgatggggttgaatttcaatacaaacctgaattataagaaagaggtgctaactatgcaaacacgagcgatcagactttatggaaaagaggacctgaggctggatacatttgaactgccgcctataaaggaagatgagattttggtaaagatcatttctgacagcgtctgtatgtccacttataagctgtctaagcagggggcagcccacaagagagccaggccggatcttaaagagaggccttcggtcatcgggcatgagatgtcaggagtcatcatagaaacaggcgcgaaatggaaagacctataccaggagggccagaagtttacggtgctgcccacggtcactgaaaacggccggatgaaaacagcgggttactactacgagacttatgggggagactgcacctactgtattcttccccgggaagttatggagcacggctgtctgatcccatttaatggagactccttttttgaagcttccttatcggagcccacggcctgtatcattgccgggtatcggagaatgtaccacacatcggaggaagaccatgaacaccgtatgggagtgaaaccccagggaagtcttgtgatcttcggagcgtgcggacccatgggactggagtgtattgactatgccttacagctggaaaacgggccttctaagattgtcgccgtcgatatgtccaaagaacggcttaacagagcagaaaaaatgctggttcctgatccggaaagcggaaaagagctgtattttgtgaacgcaaatgaatgccgggatatggcagaggaactgaaagatctgaacggtggcagaggatatgatgatgtgtttgtctatgctccggtggaagccttgatcgagcaggcggaccgggtgctgggaaaagacgggtgcatgaatttctttgctggccctgtggatcaatcgctttcagccaggatcaatatgtacaatgtgcattattcatacacccatctggtgggatttaccggaagcaccaatgaagatctccatgacgccctgaagttgatggaacaaaaaaggatccgccctacggtgatggtaacacatatcggaggcttaagcagtgccattgagactactctgcatgttccggagatcccgggcgggaaaaaaatgatctatacacagatcgatctgccgctgacagctattgaagattttgcggagcttggcagggagaatccactgtttgaaaagctggcagtatcatgtgaggcccacaacggatgctggaatgcggaggctgaaaagattttgctggatgaatataatgtggatttgacacgatagggaggaagggaatgttagttactttaaagggattattagaagatgctaagaacaaaaaacaggcggttggggcattcaacggaaccacattggaaggaatccgtgccataatcggtgcagctgaggagcttcagaggccggtgatcctccagcatgcccagagtcatgatacgatcatagatttaaatgagattgccccgctgatgctgcactatgcaaggagtgcctctgtgccggtggcagtgcatctggaccacggaagcaccttcaaacggtgcatggaggcaatacgggcagggtttacttctgttatgtatgacgcgtctgccaggccgtttgagcagaatctcatggagacggcagagattgttaaagctgcccacagtgtgggagtatctgtggaagcagaacttgggcatgtggcaaatgtcaatgaggatcccggggaggacaacatttatacggatcctgctctggctgaggagtttgtgaagcgcactggagtggactgcctggctgttgcctttggcacagtgcatggtctttatgtaaagcagccaaggctggatctttccattgtaactcagatcagtgaaaaaaccggcattcccctggtcatgcacgggggctctggggtatccggagacaattaccgcagagccataaaagagggaatctgtaagattaactattatacatatatgaatacagcgggagggaacgcggctagaagctttgtaaaacagtccggagaacatctggcctatgactgtctcacactggcggcgacggaagctatgaagcaggatgtgatggctgccatgagaatatttggaatggatgagtgacctgcagatctgctataatcgtgtcagcagagggaatacagtcagtgtgggagggagaatgatggcagatgcagaggaagtcaggatgcttgctgagatcaccaggctttattatgaggaggaatggacccagcagaggatcgctaaaaagtttaatatgagccggtccctggtctcgaagctgctttctaaagcgaggaagctcgggattgtagagatcattatccatgacgaggagtttcacccgtacaggaagctggaggaggagcttaagaaacggtttcagatcagagaggcagtgtgcgtcagtgtggaaaacagtgaaaatccggtaaaaacagtgggtgcggcagcagcaaaatatgtggcgagaaagctgtccactgtgaagtatgtggcaatgacggcgggaactaccacccgccagatcgctgagagcttttcatcgggtgtgccctttgaccatgtgacatttgtacctatgtcgggaggattgggggaagaacggtgggagatccaggccaatgtggtgtgtgagcggatggcaaagaacagcggggggaacagccttcagctgcatgcccccattgttttagattcctatgaggcaaaggaaatgcttttaaagcagcactttattaaaagtgtcatggaaaaagccagaaatgcggaactggctgtggtgggactcggcagctcacctcagtattttgagctgaccgaatcttatctgcacgggatcaaccgggagaaggatgacatcagcagacgcctggtcggtgacatttcttataattattttgacaaagagggagaactgatagactgtaaatggaacaggcagctcatctctttaaatattgaagagatcaaacggattccggaagtgattgctgtgacagaggggacagagaaagcggcaagtctgtatgcggctttgaagcataagatcgtggacggcctggtgaccgatgttcattccgccagagagctgatcgagatggatcggagaaggcttatgggaaaggaaaattaattttaaaatagactgtttggaaaatcgaaaatgattttccaaacagtctattttacatttaaattccattacagataggtttgcataagatttaggattattttaattataaagtatagaatagcagtgtatgatatgaatttgccggtcttagctccaagatcaccgggatgtctcatagctaaaagaagtcccagaaggcttaatatcaaatagagaaataaactataatgcagtccgtccagcgaaatgattccattttgattgcctgaccagatcggaattccaaatcgcgcaagaatcatatctccatagcaggtcataggtggaaaagtaaaaccaaaaaacagagtgatgacactgaggacaatggaataagttccaaggccagatcttctgccactattatatcggttgaccagacaagctgaaaccttaaaaaaagtataacccaaaagtcctccaagggtatttgcaatcagatcatcaatgtctgccagccttcccacgaagaaaaactgaatgcattcgatgaaaagtgacaaaagcaatataaatagcactgtttttttcagacttcgtttttcagtgtgctgcattaaggggacaaatactcccatgggcaggaacaacaggatatttaatatgatgtaagaaaggttttcaccgataaaaggaatcagattatagttatgggctccattgagactccaggcaacaaaagcaaacatgcccgtgacaataccaacaaaaacaagatatacagtaaagaggtactgcaaaaaccaatcgccgtttttaaaagcttttgtctttcccattacttttaatacaattgcaattaatgcataaataatcaatccagcgataagagcctgggcaagcagtatagcgcctttagaaaaattttctctcatgatcaatcctctttcttccatcggagcacagacaataatgtcaggtaacagccaaccgccaggaaaaacagccccttttctgttttaatgatatgatctcggtataatttcctgataaccaacagaaaagctaaagcagatgaaagaaaaatcagaaaagtttgtgcaacaacctgatgatactcatttttattatcataatgtagatacccttcacacttgtcagataaaagaatctgtttaaaatccagagtatcctgaatttcttcatccacattgacatttgtttttttgtctagaaaacctattattttacagcggatatttttagttgccagatatgagttttcaacaatagaattcagcttaaaaatatgtttataatttgcacccgccacaacaggaacgatctgattagaagtttttttatatgcagatcgtttaaaaaattctccagtttgtactctttgatcgagattttgtctttttgcatagagctctgaaacctgcatagatttcagaggtgagatcagcatatcatcaattttttggtttcctttaccattaatgaaactcttgctgcctcgaaactttttcgtataaataaaatcttggtttgatatttcataataatcaatattttttatattcataagctgttgatacacctgttttaaaatctttaaagaatccttttttcttagaaagttttcataacggtagccttttctgtcgtaattgtcagccagcagccaatctccttggctgctattttgagaaattgaagaattatttctttcgacaaataaggcataagaatagacagatgatccaaagacaaatatgattataatggtcacgaaaaccagataatgtttcagcctgttattaaaatccataatacacacttgaagaatacaaatcaatcagacagcaattttttgtggcccatccggtactattctccactttgccttttccccatattctttttgaagttttccaacatcctgttgaatagtctgcccacaatttgactgtaacataatgcttctggtttgccgttacataccccttgccgtttcctttaagataaccttttttccagttcttgtttgcttttgcttctttagccgtgatttccttagtcgaaacccaatgttttgatgccttgactcttttatccatggcgaaggcagaagtagatgaggaaaatatagttgttgtgattaataaaccaattaaaagtcttttcctgtcaatacctttttttaaatattaatagcttccattatatgtatataatctttgtacactataccattgatgaatcttttagtcaagactaaaagaaacgttaagttgtttacattttatgaatactattattaagtacttcttttatctggttgttttccagacgatcataatggattccgcattggatacagacgggttcatgcaggctttcccagagggcattgtcccggcgtgtactcacatatccgtccttatgtcccggaaaccgtagggtttgaatatttccattataccccataaagctcaccacgccaatatgagtgcggcttccacctgcgataagaacctggatgccctcatcgagacgggttacatgggcacagatctcataccggaacaattctgtcttcagcaaagtctgctttatcatttcattttccttcccatcgctgaaatccttcaaattctactccgaactgatctaaaatcttgccggccacgtgtcttgtcatatcctccacagactgaggatgattgtaataactcagtacagggggcaggatgacggcgccagcctgggaaacttcatacatatttctcaggtggatgttgctaagaggacactccctggccacaagcacaagcttccggcgttccttcaaggtcacgtcggcggcccgtagaagcaggctgtcactgtatccgctgtgaatccccgctaaggttttcatactgcatggaacaatgatcataccgtccatgggacaactgccgctggctggagcggcaccgatattgcggttatcatagactgtatgggaaaggccctggagatcctctaaggttaaattggtttccagtgagagggttcttgcggcactgtctgtccagacatccacgggctgggatcaacgtctaaaagctgtgctctttggaactgctcttttaatgaaaaaggaacagtacagtcaaaaatggtcttgcaggcgatcccatgatcccggatactcggtgaaaagtcaggatcattggacggatccagcggatgacagcggacaccggggatggtgatgatatccgcatcaccctggaacctggtgttcatagcccataacacatcattcatatcaaaacagtccacatcttcatcaacgaggaatatgtgcttcagttcgctaaaggcagaaaatgccagaagagcagcctgtctctggcgtccctcatcgctggctgtttttttgcagaattgcaggaccgccatatatttgcctcccccggcagaacagcagtatacattctgaagacgtccgggcatggccttttcgatcattccgataatgctggcttctgtggtgatacctgccatggatacatgttcttcgctgggaccgatgcaggtttgtaaaataggatctttccggtgtgtcacagccgtcaccttgatcatccggcactgtgcttttccatggatcaccactgtctctatgggatgtccggcacattcaaacagcttccatccaagcttctcaggagaacaatccgcaggcatcacacctgaggttgtccggaccggaagagtagaatccattatcagcggcgttgcagtgggtgaaggtatcagcctgctggcaaaaagcaacttccggatctttcaggccggccaggtgaaggttgtaccgctggatccgcctacgaaattatctgttgtccttgcaaagcttgcgggaacggcgcagacagatgccatgaggatctttgcggactatatgtgcaaagggtgtgaggtataatactatcatcacaccatccgctgcctttattcttttatagttttctgatctgtagtgccatttccataatacaatcttttgtctgctggcaaaatcccaggcggtcataaaaaccgtgatccataccctggtaacggatcacctcacacggtataccagaatcccacaatttttcagcaaataaatcgttggataagcggaaatagtcaaattcggcttcgatgattactgctttttttaggttggacaaatcatttgcataaagcggagaaatcgaaggatccttcacgtcttctccgttggctgcgtacaaatcatgaatggtattgtttaaaatccgaaagcggttgagtcttgtcattgcatgattgtagtgttccgggatgacttcatatttatgatagtcccagtagtccgtatcttcggcataagataaatccagtgcaccgtacacaggcatggtcagcgccactttttttcctgtttcagaaagggagcatgaaacagcaaggttgccgccggcactttcgccggcagcagtgatttcgtttctgtccaaattccattctcccgcatggtcccagatccaagagataacctctttgcagtcattgagggctgcgggaaaaggattttcgggaatcagccggtaatccacagaaatgacagtggctttagattgttctgccagaaatctgcattgatgttcaaggaccttcgtacttcccccgaggaagcctccgccgtggaagaaaatcaccggtttctgcatttgcccgtttggaagacgaaaaaaggtaacagggataaagcggtcagaaagtctgatcaaaaagggtatctgttctacagtttcatctgtaatgtccacattgttggagcccatttcaagcctcagggaagaaagatccataaaaggtgtgaagggagctttctcatagtctgtcagaaaaactccggacttttccaccttcccgatcacagaaggatcgagaaggtggtccctgttacagccgggaatttgtttcagtctgcagcaatcattacttccagcataaaaagggatcattttttctttaaacatatagatctccttataatgattcaatgagcagcagatcttcctgggaagagacggatccctcccggagtaaggtcatttttctctcggagccgcctgatgtatcaacaatgatgaccgtagggtcaaaccctgcttttttaatctcatctatttcaatggcagcaattaattctccaggcatgacaatatcaccagtctttacatgagacttaaagtatttcccatctaattttaccgtgtcgattccgatatgtattaaaaattcttcctggttttcacttacaatgccatatgcgtgcagggtcggataaacggcggccacagttccagcaacaggcgctgtaatttttccattttcgggaatgacggcaataccttttccaagtgcctcagaggaaaatgcaggatcctttactttgttcaaagggagaactgtaccgtcagcaggcgcatgtactttgattgctacagctttggatgtggatgtactgagctctgtatgatctgccgtgacatttacatcagcccgttctgattccggtatcatagaatcattaaaaccgaaaagataagtaagaacagcggaaatcaggaaagcaccaaaataggcgattacaaacccggtaaatccggcaccgaagtaagcagggaaggttggaacggcagcgacggctacagccatagccctggcaccgcaggctcctgcaacggcaccaccgatacctcctccgatgatagcagccgcaaatgctctgcgatattttattgtaattccataaatcgcgggttcagagattccgaaaaatcccatgagagccgcaggggccgcgatctgtttcagccgttgatcttttgttttcagccatacaccgaaagcagcgcctgactgggcgataatgctgggaccaaatacagccaggatggtatcaaaaccaaacttttcaatgttggagaaaatgatcgggaataatccccaatgaattccgaaaataacaagcacctgagcaatggcgccgatgaaacctcccgcaatcatagggttaaatccatacaggttcatgtaaaatcctgctatcgtattactgagcatagagccaagaggtccaaagacggttatcgtcacaggaactacaattaggagagagaaaaatggagcaattcggcttctgatcttctcaggaagcagttttgcgaggcctttttctacatatgagagcagtaagatcgcaaatataattggaaatacgctgctcttaaatgtggtcagctgtacaggaatacctaaaaagctgatagcctttccggcatcataaagagccgtcagattcggatataataatgctccggcaattgttacggacacaaacatatttgtcttaaagcgtttggcgcaagtgatcgccagcaccactggaagaaaataatatagactgtccgcagctgcatttaaaatctgataggttccgctggcgtccgtcaaaataccggatgcagtgaggatgctcaaaagtccctttaaaataccagcgccgatcagaacgtcaatgaggggagtaaacaggctggagatgatctccagagctgaccctaaaaaccctttctttttctgactgccggcctccgaagaagcagaagaactctgcggaaagatcccctggagttcttcataaatgtactggacctggggaccgagtacaatctgggtctgtcctgccacatccatcacagatagaataccatccagcttatcaagactatcccggtcgattttgccggaatctttcaggtcaaggcgaagccttgtggagcaatgggaataagaaatcacattccgcttcccgcctactttttgcagaatttcttctgccatttgtctgtttgtcatgttgtttcctccttaagattgaaataatttatcttaagtcttgcctgcccgaagcagtcacaatcttagcaacttatgatttacagctttctgctctctgacagcagccgttcaatgtgaatggtcagatagacctgttcacttttcgtaatggtgtagttatagcttttttgtatatataaagcgatcttccgggaacattgaaatgcttccggcatgttttcctgaacctgagggtataaaaaggatgcttcttctgccggaggctcattcatcataagccgctgggaaaagaattttaaatgcagtatgaaccttgtatagtttaaggaattttcatcaaaatctattttaaactcatattgtacaatgctgcagattcctttgatcagccttgtcatatcgatgactgactggatttcgtgaccgttaagttctgcattaataatatgcagggcaacaaaactggcttcatcttccggaagctttacattgagagtggaattcatcagtttgatcgcttccaacgcaatctgatattccttagggtagaaccgtttgatttcccacatcaactgattttggaacaaaagtccttgtttaaaacgttctactgcataatacatatggtcacatagagtcacatagatattctgatttaattccttagaaagcttttgttctgcatgctgtttaatctgatccgccagataaaagtagtcaataggaatctgttttaacagctccgaaagtctgtttcctgtggcttcttctttcagtataaaaattcgttcaattttttctgcctccaccggatccccttttctcttctgaaaacccagtccaaggcctgtgagaataatgtcctgtccctcttggttttttgaaaatatgacattattgtttaagacctttttaacatgaaagcactcctgctccatttttatccctcccccaaatataaaaagagacctaaattataataagacataactcatgccttattataattcaggtctcgcctattctataatagtcacgatccctatcgaattgttgatacaaatttatcacagctgccgtaaactgtcaactggatgttgagaatttgtataaatgtgataaaaacaaaaacaaactttggtcagatattacaacatgataaccgtaacacccatatctccctcaccgaattctccgtcgcggtatccagagatccgtttttgttttttcagagtctttaagtagttatggattccttttctcagggctcctgttccctttccgtgaatgacggtaatctgtccaaggtttgccagacaggcatcatcaatgaacttatcaagctgggagacggcttcatccactgtcataccaaggacgttgatttcaggacggatactggaagacttattgatcgcagtccgcccactgtttctggcttcatttcttgcattttcccgtttcacctgtttcacactcttagtgatctccaggtctttgacattgactttggagcgcatcattcccatctgtacatacaagtctcctttggagttgggaagtgtctggactgtgccgctcagggaaaggctggtcacataaacctcatctccaacctgaaaatctccaggttcatgttttttggacgctctgtttttagaacgatatgccatatctttttccagtctggacattttgccgcgaagatcacttcgcatatgctccattttcctgtttgcatctttgcctgactgcttctttaaattgttatattccttgatcgtctcatcggcagtttcctttgcctcggaaataatccggtaggcttcctcacgggcctcgcggagaagtttctcacgcttttcttttatattttcctggcgttccttcagactctttctcaggttttcgatctctttccggtattcaaagatttcttcctgttcctgctcaatcgtctgcttgctcttttccagatcagccagtatggtctcaaaatcttttactgattcatcaatctgatccgatgcatgcacaataatatggttatcgagtcccagcttccgtgaaatcgcaaatgcattactttttccgggaatgccgatcatcagccgataggtcggggataatgtctctacatcaaattcacaggaagcattttcaactccgtccgttgagagcgcaaacattttcagttcgctgtaatgagtcgtcgccatagtttttacgccccggtcatgcaggtccgtcagaatggatatagccagggcagcgccttccaccggatcggttccgccgcacagctcatccagcagcaccagagagtgacgatgggcattctgaatgatagagacaatattggtcatgtgggaggagaaagtactcaggttctgttcaatactctgttcatctccgatatccgcgaatacctcttcataaattcccagactggaaccctggaatgcaggaatatgaaggcctgcctgccccatcagtgtaaataagcccacggtctttaatgaaacggttttaccccctgtatttggcccggtaatgaccagcatagaaaatgcatcgccgagagagacgttaatcggaaccacttttttagggtcaagcagagggtggcgcccctgtttgatattgatcacgccgtcttctctgaaaatcggtttgctgccgttatagtctttggcatatttagcctttgcaaaaataaaatcaagcagaaccagaagcttttggttctgtgccagaccatccatatcgtaggaagcctgttcacttaaaagcgataatatacgctcgatctctgtctgttcctgtccctccagctcttttaactgattgttcagagtcaccaccgccatcggctcgataaacagagtagaaccgctggaagactggtcatgtatcattcctttaaactgtccgcggtactcctgttttaccggaatacaatagcgtccgtttctcatggtcacaagggcatcctgaagcatgtctttgttggaggaagaactgaccatagccgtgagctggctgtggatcttctgattggtcagtttcatatttctgcggatgtcttttaaggcggaggaggcatcatcactgatctcttgcggtgaaataatacagtgtctgatatcctttaacaggccgtccatcggtaccagagactcaaatacagaatccagagaatcggcatccgccatatcatcccgctgtgcaccgtaggccagtgcattttttactgcctccaaaagaccggcaatctccagaagttctccggcactcaaagtccctttcattttcaggcgtttcagagaagcccccagatcatgtactccaaaaaatgaaatacttccctgtttataaagtctggtcagggcatcctgtgtctgttcctgggccagggatatttccggttcatccgtcatcggctctaatttttcacaggcggcttttccaagctctgtggtggcatacgctttaagcctttcgatgaccttgtcatattctaatgtatttaaaactttttgattcatatttttccctcagattattcaaaaaccattatttatagaaggttttcttttttagatttagaaaaagtgtagcataaaatatgtggcatgtaaacgagccaaacggcaattttccagtggattttcgggacagtttatgtaataatagggaaagtaaaagaggtgcgggctctaaggcggccctagaaaggttaaattatgagatatataagtgagctgcatgaaggagatatggtttcggaggtatttttgtgcaagacaaagacatccggcacatcaaaatttggaaagacctattattctctttcgctccaggacaaaaccggaatgatcgacggaaaagtatgggaacttaacaatgccatcggacattttgaggccatggattatatcatggtgaaagggaaggtcacaaacttccagggaaataatcagctgaatattgaaatgatccggaaggcagatgaaggagaataccagatttccgattatatgccatccacaaaaaaagatatcgatgaaatgtttgatgagcttttaacaatgatccagagaattcagaacccgtatttaaaagaacttgccatgaaggttttcgtagaagataaagagtttgtaaagaagtttaagattcattctgctgcaaaaagtgtacatcacggatacatcggcggcctgctggagcactctgtcagcgtggcaaagttatgtgaacagtatgcagttctgtatccgcagttaaacagagacctgctcgtcacaacggcactgttccatgatatcggaaaggcagaggagctctcagcatttcctgaaaatgattatacagacgaaggccagttagtgggacatattgtcatgggaacgatcaagctttccaaactcatggatgagatcccgggattccctgtaaagcttgccaacgaagtgaaacactgtattctgtcccatcacggggaactggaattcggttcaccgaaaaaacctgcattggcagaagcacttgcactgagccaggctgataatctggatgctaagatggagacatttgcagaggtgatcgagaagaagcaggaaggccaggaatggtccggtttccagcgtttgtttgacacaaagatcagagaatcatccatttaattttcattcatggatgatgaaataagaggtgcctatggaatttaaaaagaatcaattagtggaagtggaaattgatgatatgggcaatgaaggagagggcatcggccatgcagacggctatgccctctttttaaaagatgccgtcgcgggggacaaagtccttgcccgcatcatcaagataaagaaaaattatggatttgcaagagtagaaaaactgcttgtcccgtctcctgaccgtgtggagcccaaatgtccttccgcacgtccgtgcggtggatgtactctccagcatctgtcttatgaaaagcagctggagtataaatttaataaggtaaaaaactgtctggaacgaatcggcgggattgaaaatgcaggctctttcatggaaccgatttatggaatggacgagccgtattattatcggaacaaagcccagtttcctgtgggacggaacaaggatggaaaactgatcaccgggttttatgcgggacggactcattctattattgactgtacccactgttcaattcagcatccggtcaatgaggagattcttaaaaaggttcttgattacatggagaggaaccatgtggagccttatgacgaaaaaaatcatagaggattggtgcgccatatcatgacccgggctgggtttgtcacaggggaaatcatggtatgtctcgtggtgaacggcaggaagaaggatcttccgaatctttctaaactggtggagtctttaaaagaggttgagggtatgaccagcatttgtgtcaacagcaaccgggagaggacaaaccggattatgggaagtaaggtagaagaggtttatggacctgcttatatttatgactatattgggaatgtgaagtatcaaatcgggccgctgtcattctttcaggtgaatccaaggcagacgaaggttctgtatgagaaggccttggagtatgccgagctctgcggggatgaaactgtgtgggatctttactgtgggatcggaacgatttctctgttcctggcacagaaggcaaagcaggtctatggggttgagattgtgaaggaagccattgaagatgccagattgaatgtcaggatgaaccgtatggataatgtgaagttctttgtggggaaggcggaggaagtactgccacgagagtatgagaagaatggggtttatgcggatgtgatcgttgttgacccgccccggaaagggtgcgataaggcattgctcgatactatggttaagatggggccggagaggattgtgtatgtcagctgtgatcctgggacattggctcgggatttgaaggtgctggggggagaaggatatgaagttcggaaagtggcggttgtggatcagtttgggcatacggggcatgtggagaccgtggcactattgaagaggaaagggcagtagagttttccgccagaaaattgattcgtcattggacggtagacatgcctgggaactccagtgttttagaggagaagaaaatctattatgaaagaactaaaagaattaaatattaaaagcatagaagaaatcaaatcattatttgcagagatttttacaaaggagccctggaatgatgattggagtgacttggcacaactgcatgaatatattatggatttaataggaaacaggaattctttaacattgggtctgtttaaaaatgatgaactcattggcctttcaatgggaagcatcatgcattggtacggactttttacaagccgttgaacaatatgccaaaagcaaacaggtaacgcatatttttttacagacagagagaactgttcccgcttttaatttttataagaaaaatggttttattgaattaaaagaccatatttcactctataaagaatttaattaaaggagagtgccatggaatataagatcagacaaatgtatccaaatgaatacccttatctaaaaaagtttttatatgaggcaatttttcaaaaagacacggaaactcttctgccaaaggaaatcatcgatgaaccagacttaaatatatacatagagaactttggaaaagaacacgatcattgtctctgcgccgaagcaaacggaagaatcataggagcagtctggacacggatcatatccggatatgggaatatagatgacgtgactcccgaatttgcaatttccctttacaaaaagtatagaggaaaaggaatcggtacaaaaatgatgcaggagatgctgtctcttttaaaatcaaaaggatacaaaaaggcttctctgtcagtacagaaagaaaattatgcatttaaaatgtatcagaatctcggctttaaaattatcgatgagacagaggaagagtttattatgatgtatgatttgacaaaaacagttatttagccgctagtgtaaggaggaatcaggttgatgagagaagaaaaaacatctccaaaagaagctatcaacgaactatcactgcttttaatgtatctaacaagattcagccaccaggatagattttcattagaaaaaaacaaagcctggaaagggtatccctttcatgccttggatgatcttgaggaagaagggctgattgatcagggaagccatcgctctaaatctgtacatatttacgaagaaggattggagaaagcaaaagaattactcgtcaaatataatataaaagactgggatgaatgagcagacaacaagcaatatttaagaagagaaaggattatggcatgcctgtcaaattggaagacacaacaaaagcgagaaaactgttcggagaatggaaggaaactttaatctggtcctgtcttcaaaaggtcatgggagacatctatgtggacaatacttcagatccacagtccgctatggctgttcttggtgatttctgtttttttgccggaaatgcagaggaagatttagtctcttataaaccggaaaactgtttccaggactttattattatggtgccgcagtctgaggaatgggcagaactgatcgtcaaaaagtatggagacagagcaaaaccagtaacacgttatgccataaaaaaagaacagaatatttttgataaagatactttaaggcctgccgtcaattcgttaaagccgggatataccctgcgaatgattgatgcagacctttttgcgctatgcagatcaagtgcatggtgtcaggatctggtctcacagtttgaggactatgagacatataaaaagctcggcataggaattgccgtattaaaaggagaatcgctcgcagcaggagcttcttcttatgcaagatacagagaaggaattgaaatacagattgacacgaaggaagagttccggcgaaatggactggcttatgcttgtggagcaaagctgatactggaatgtctgaacaaaggtctgtatccgagctgggatgcccaaaatcaagcatccgctgcacttgcagagaaattaggatatcattttgaccatgaatacaaagcatttgaaatatggggatattaaatggagatcaggttattaaacgaggaagatgacatcgatgcagtctgtggtatctatgcggccagttggaaaagtacatatagaggcatcatccctcaggagtttctggataacattgataaagaaaaatggcgtgagggaattcaaaattctgaattgatttcattagtcatgatgaatggtgaaaagatgatcggcacggcctcctactgtgcttccagattcatcagtcttaaggggtttggggaaatcgtctcgctctatttgcttccggattactatggaaatggatatggcagacagcttttgcaggcggcggttgacggactgtctgagatgggattttcagaaaaagtaaaggaagaagcaaagagaaaatcagatttcaggtgtgtcatctgtcaggaaccgtttgttgaagtacatcatatcattcctcagaatgagggagatgaagatacgattgagaatgctgcgcccctttgctccagatgtcacgatctatatggagacaaccctgcaaaaagaaaacagatccctcagatgagagactattggtttgaagtcatggagaagagaaataaagaaggtttggatgcgttagtaccgatcgcgtccgatcccgacagagtgaatgccctgcgggacaaggggatagccatccagcatactgtttttgcagagagtaaaggtattaaggaatttattcttttatttacgatttctttcttttttctcacacaatacatttctatttatcttacagcaaatttccataacagcaaattcataatggatcaaagggctgagaaaagcccgcttttagtaaacgcagctgcggcaggggtcattggcccggcgaccgaggaacttttattccgcagatttctgtacaaaggattaaaatcgatggggaaagaaaagtcgtctctgatttccagtgttattttcgggctgtgtcacagacatgtgatccaggggatctatgcagcattgtgggggaaagaagcatcacagcttaaaagcacctttttcagctcatatgatcagcaatctgctgtcctttttaccgatcctttggatcagcctgaatcattgtgaaaaagaggtataagggatgcattcttcctgtcttatttatgcccgtatctgtaaatcacttctttaacattcgccaaagcgtactccggctgattccaagcctcttagcggctcgttctttatttccggcttcctccgtaagcaccatatggatgatctggtcattgatctcatttagtgtgccggtaagatccagaccggaaatatcagcagaaggatcggcggagggttcgttgtccaaaatttcttttacgttttcataagtaatatatggagtgcgggttataaccaccaattctttgattatatggtgcaattgatcgaggttgttaggccatgaaaaagcagtcatcaaatccatagcttccgcctcaaagccgataatctgcttgccggtagcgacattcatacgatgaatataaagcgtggcaatgctcgatagatcctgaatgcgatctcgaagcggcaaaagcttcaaagtcatgcaggataatttgttctcgagataatttcgacatatttccgtctgatccttttctgaggaattcaggatcagcgaaaaaatcagccggttccttctggcgagctctgaattatcaatataagaaaaaagcttgtccaattgatttttcgaaagcgctcccggatttttgatatagatgtttgtattcacatttgcgaatggcgaatctgaattattgatcagggcattccattttcgttcccccataagttcacaattgatgatatataaaggggaagaattcccggagctgttggaatataaaagctttgcaactttatctttccctgttccggattctcctataatcagtaccggctgtgtgctctttgcatacgcttcgataatatcggccgtacgtcccacttggtgagagccgttgtattcatcggcgaaatcttctgagttcgaatccaaatgattgtaaatagtaattactgagtcttcttcggaaaaaacggcatgtttctgttggatggttattgctgtatatttctggtcttcatagaataaatgccggtttgtaaggatgaagattttatcgcggatctgtctggtaactgtctgacccgaaactttcaaaaaagcccgaagataagtctgtacaagattcataaggactgtattgctgtcgttatttggaagactggaaaaccataaggctccggctggattaaaaatcagaaattcccggtcttcattggtcagaagagcctgaaacagatctttctgtttgtgaacatgagcagaagacgccacgagtttgacggcttcatcaattgcagaagtgatactttcgcttccggaagaaagaaggatagaattcatccccagcttcctggctgcatttaaacctgtcatatcacaaagagccaatgtacagccgttctgctgcgccttcctgattgccggcagagcatccgattcgttggtaaacgttacaatatcaatatcatactgcagtaggtcgcagagcactttggcgcagtttgtgatcgaagaaaatccggcgattataaacttgccggaatagctttccacaagtttaattgtgcggagcacatcatacacggaaatcgggatatcgattaccgggagctcgacgttagaacgtatcaattcggcagttccgcctcttgaaataataacgtcataattattatgtgccagttcgagggcgatttttttgccgttatccaaatcgcctgtctgtaccgtcatgcggatatcatctcttgtctgtgcgattgcagatatggcatccgccattccttcataaggagctactgcaagtatcttggttttctgcatatggatttcccctttgtaaaaaatgaatttttatcgttgagatattcgctttcatatagatttattatatacttgaacgtatcaaaatgcaacaaaaattaagctggatgtttcaaaataaaacgataaaatgaaattgtgcaattgaataacgaggttttaagaagtaatatgttaaacaagaaaagcaaagaaacacaaaatatttcaaaacgaatcaaaggaggaaagaaaatgagttatcagattaaaattccgtcatatatctgcggaggggagggatgcattgaaaatgtagctgcaatcatcgaaaaagaacatgcaaagaagattattgtatttacagataaaggcatcagacttacaggacttttggatatactgacgaaaatacttcataaaacaacggccgaatatcaagtatttgacaatttgactccggaaccggcatatcaggatgtagaaagagtcatggatgaggtcgcgtgctacaatggtgattttattatcgcgattggcggcggaagcgttatggatgcggcaaagctctgcagtatattaaaagacgctccttatacgataaaagatcttctgagagatcctgcaattgctgagaaacagattaagaccctgatgattcctactacttgcggaaccggatcggaggcaacatgcaacgctatcgtagccattccggaagagcagtcaaagaaaggaattgtgaacgataacatgattccggattacgtatttctggatccgcagatgatcagaaagcttccaaaatctatcattgcagcaacgggcgtggatgcgcttgcccatgtagtagagtgctttacctcaaaaaaagcgacttcgttttccgatacgtatgcaatggccggtgcaaaactgatctttcataatatcagagaagcttacaatgatgcagatcatatgaaagcaaagggtaatatgatgcttggcgcgttctatggcggagtcgctatcacaggaagcggtacaacggctgtacatgcgctgtcatatccattgggcggaaaataccatattgcgcatggcgtatccaatgcaatcctttttgcacatgtaatggaattcaacaaagacgcctgcagggaaagacttgcggaattgtgcgacggagtgttcccggagcttttcgaaaaaaatgtggatgaaaaggcggactatatgatcgaacagattgtagacattgtaagagtgacaaacattccaacagacctgaatgaattcggagtaaaaatggaagaccttgatttccttgtaaaggcaggaagcgatcaaaaaagacttttggtaaataacatgaaagaattatcactggatgatatcaggggtatttacctgagagttctgaaataaaacaattatcaaagaaagggcaggagaaatggaaaagaaaccaattatcggaattacaatgggagatccctcgggaaatggatctgaaatctccgtaaaagcactttcagacccggctgtgtacgaaagatgtaagccaatcattattggagatgcgaattgcatgaaaaacgcagtggagtttcttgggaaagacaatgaaatccggatccatgctgtagaaaatgtaaaagatgcggtattccaacacggaacgatcgacgtctatgatatgaaactggtcgatatgaaaaagcatatatacggtaaagtttcaaaaatgtgtggggaagccgcattccagtatgttgtgaaggtgatcgagcttgcaatgaaaaacgagattgatgcaactgtaactaatgcgatctgcaaagaagccattaacatggcagggcatcattactccggacatacagagatttacgcagattatacagataccggcaaatacaccatgatgctcgcccatggcgatctgagagttgtacatgtgtccacgcatgtttctcttcgtcaggcatgcgagagggtaaaaaaagaacgcgtgctggagtgcatcagaattgccaacgatgcatgtaaagcgatcagaattaaagagccgaagattggcgtggcaggtctgaatccgcactgcggggagaacggaatgtttggtacggaagagattgaagagattcagccggctattgatgcggcgctggaagaagggattcatattccggagaagaagccgacgcctccggattccattttctctaaagcaatcgggggctggtatgatattgtcgttgcaatgtatcacgatcagggacatataccgcttaaggtagaaggattcaaatacaataaggagcaaaagaaatgggacgccgtatccggcgtcaatgtaacgcttggcattccaatcatacgcgtatctgtagatcatggaaccggatttgatcttgcaggaacaggaaaatgtaacgaattaagccttgtaaattctattgattatgcgatccgccttgcagaaaacaaataatagcgggaggaaaacgacgtggtaaaactgttgattatagccgatgattttactggtgctttggatacaggaatccagtttaaaaaacgtggcatcagcacacaggttttcacaaaaacaaagttggagaatagtgaaatcagaccagacacagaggttcttgtgatcgacagtgaatcaaggccaatgcagaaagaagacgcgtatctgaaagtaaaaaagattacagagtgggcgattgcccgcgaagtacagattattttcaaaaaaacagattctgcgctcaggggaaacataggggccgaggtaaaagctgtcgccgatgcagcgggaaacggcaaagtgttcttccttcccggttatccggaaattcacagagttacaaagaacgggactcattatatagacggtgaattgctggaaaacagtgtatttggaaaggatccatttgaaccggtaaatatgtcgtacataccggatatcatcaaaaaagagagcgatgttgccgtagaggtattaaagagaagcgagaagattcctgaactggcaaaagaccaaccggagattatcgtatgtgatacggtcagtacagaagacattgataaccgactggacgagctgattgagaagaacgctctcgggctgttggcggggtgcgcaggactggcagatcgtctggtagaaaaaatatctttcaaccggcaaggagagatggcatttcacaagactgacgggatgtatgtagcatgcggaagtctgaacaagattacagaacagcaggtttcgtatgcggaaaagaacggcggatttacaagaatccatctgacaatgcatcagaaactgatgccggaatattatgggacggcgcagggaagatcatttacacgcgaaatagcgggactctgccagcgcaggaagaaagtgattgttgatacatttgattcggatgacagcaaagaacaatttctgaaagaccacaagatagaacaggaatctgtcagattcagaatctcagattcgcatggctgcattgtcaacgaactggtaaaccaggggctggatcttacgatcctgatgacgggcggggatacgctgatgggatatatgaagcaaatcggatgtacgcagatcgaaccaatatgcgaaattgaacaaggcgttgttgtatcaaaaattaaatgcggaggccattccatacaggtaatatcaaaatcaggtggattcggaacagtcgatatcctgtgccgaatcgcagagaaagtgcttcataaaaattcaaaattgaaaggagaacgcatcatgaaaaaagttgaactgaagggaattatcacaccaattttaacaccgatgaaagcggatgaaagtatgaatacagaggaactccgcgcacagattgaacgtctgattgacggcggtgtgcatggtattttcccgtttggaaccaacggggaaggttatatcttaagcgagaatgagaaggttgaagtgcttgaagcaacgatcgatcaggtaaaaggacgtgtacctgtatatgcaggctccggatgcatttccacagcagataccatccgtatgagcaggaaagcggaggagcttggggcagacgtgctttccattattacgccaagttttgcggtcgcatctcagaaagaactgtatgaccattatgtagaagttgcaaaacatgtggacacgccgattgtactttataacattccggcacgcacaggcaacaaacttcttccgcagacggtcgccaggctcgccagagacgtagatattattgtcggggcaaaggattccagcggggactgggagaacctgaaagcatacattcatcagactcaggatcttgacaaagatttctttgtattatcaggaaatgattccctgatccttccggcattaaaagaagggggaactggcgggatcgccggatgctccaatgtatatcctcatgtactttcttctatttacaatcttttcaaagaagggaaactggaagatgcgcaggcggcgcaggattctatcgcaagtttccgcgcagtgttcaaatatgggaatccgaacacagtagttaagaaggccgttgcgatgcttggatatccggtaggagaatgcagaaggccattcaactatctgtgcgatgaaggcgtagaagcgcttaagagggttttaaaagagaacgctgataagggtatgaactaaataaaagattagaaagaagcgaggaatagaagatgaaatttgtaatgacacaggccgtgtgcccggaagggcttcagatgctggacggaatcgcggatgtttatgttgcagataatcaggatccaaacaattatctggatgaaatgaagaatgcagacgctctgatcgtaaggattgcaaaatgtgacggacatgccatcgagaacagcccgaatctgaaggttatcgggcgtacaggcgtaggatatgattccgtagatgtgaagacagctacagcgcatgggatccctgtagttatcacaccgggagccaataacagaagcgttgcagagcatgcggtggcgatgatgttcgcactttccaaaaatctggtggaagctcagacggaaatgtgtaaaggcaactgggaaatccgtggagctaaaaaagcatttgagctggaaggtaagaacgttgggattcttggacttggggcaatcggacgtgaaactgcaaagatctgtaaaggatgtggaatgaaaatagcagcctatgatccgtttttgtcaaaagaacaggtagaaggttacggcgcagagtactatgagaactatgaagagcttttgaaaatcagtgacgtagtatccattcatgtgcctctcaccgaggaaaccagaaatatgatttccagaaagcagctctcagaaatgaagaaaacggcactgatcattaactgcagccgcggcggaatcatcaacgaagcagatctgacagaggcattgaaagcaggtgaaattgcaggggcagcaacggacgtattctgcaatgaacctccaaagacagatgatccgcttttgaattgcccaaatctgattgtaagccctcattcggcggcacagacaagagaagcggtcattaaaatggctcaaatgtgtgtgaaaggctgtctggcagtagcagagggaaagaaatggccattcgtagcagacaggtcggtatatgatcatccgaagtggaaagacacggagtatgcagaagtataagaagccataataaagggctgaactcttatatttgagtgtataaagttaagttacaagaaaaactatgtggggaaacggagaaaaaactatgagttcaagtattatagcaattataattgcagcaattacaattgtactgttcatgtggaataaattgccaatgagcgttgtggctatgggaagttccgtagcaatgggaattctgattccgcagatggaactttcggaagtatatgccggattcagcgctcctggctgggcaatggtcgtcgggatgtgtatcgtaagcgcggcgctctttgagaccggcatggctcagaaaatcggcgacagaattggaaattcatttttagcaaagacggaacgcagatttatcgtaacagcaagcgctgtatgctgtttgatgtcagcgtttatgagcaataacggaacagtagctatctggatgcctctgatcgctgttgtagcggctggatcaaacggacggatccgatctaagatggttattttcccggcgggaactgcagcaatcattgggggggcatgtacgctggtcgggtctacatcacagcttgcggcgaacgcggtgcttcagggatatgacggatataaagatggacttggaatgtttgatatgacaaaaatcatgcttccggcagctatcgtgcaggttgtcttctgggggacgatcggatatactttgctgaagaaagttctgaaaccggaaagtccggacttcaatgtgggaaacatgtatgcagatgccccggcagttgaagaaaaaagcacaaatgatccggcggatggcaagaaaggagctatttcagtatttacaatgcttctgtgcattttcttattcgtggcgagtggatttgaaccatttaaaagccattttacaatcggcgttatcggtatgttaggtgcagttatcgttcttggaacaaaatgtattccggtcaagaaagcttatgaagagcttccttgggatgtactgattacaatcggcggtatcggcggacttggagcgggacttgataaatcaggcggcggagctttgatcgcaaacgcagtactgaatcttttcggagggaaaaacgcttccgtagtagttcttacaattgtaattgcagttttaacaagcgtactgacgaattttatgtcgaacaatgcaacggcggctatgatcagcccaattgctatcgcaatggcgcttggtcttggaatcagtccggttccgtgggttatcgtaattgcggcgtgttcgaatctggcaattgcaacatcttacggaacagctgtcaacatgcagattttaccggccggatataaattctccgactttgtcaagattggcgggccattgctgatcatattgatcgcagtagttactgtaagttcagtagcattcctcttctaaagttaaaaaataaaccgcatagtaggaagtatagtggaattatagcagatgttataatgaaactgtacttcctgttgtgcattgttttcgcgaacagtacatcatacaaatatacttgaagattatacggctgcagaccaccccacgggtcttcggcttgtgccggccagcagccgatggaatttatatcaggaaggaacagtaaaatgtcaataaaatcagattataaggattatgaggagcatcggaacagaattgcaggtaaaaagacaggaaaattttttattaatcaggaattgcgctatgtaaaaccatttcaaatttatggaaatttatactatgttggtgatagctgggtctgcgggcatattgtggacacgggagaaggtcttcttatgtttgatgctgggaattgtggagcgcaggcagtgctgatacagtcaatttgggaaatgggttttaatccggcagacgtaaaatggattattttatcgcatggccatgttgatcactttggcgctgtaaatttttttaaaaacatgttcggaaccaaaatctacatgggtgaaccggatgtaaaaatgtttcgggaacatccggttacgccgatgccaagtcttgtgaatggatatgccgagatcacggaagaatatttgcagaagatgaaggagcaagagtatttgagaaattcgatcaagagagatgtctcggaatagagaaaatgagctgtaataacagggccttgagcatcggataaagaagatgtttacgaggtctgctggtagcagcgtgagaatgagaacaatcggtaaaaatatctgccaaagaaagctgtttgtatgttatcatataggtgcaacttcttttttggtgatattgctaattgttatttgacatctcaattttaccataaatcattgaggagttgttttgtagcaaaaagaatgccgtatttatgcggattccggcgtttcgcaaatgcctatttgttataatagaaatagaggagtacaatatgacaaaagacaaattagcgttggagatcatagagaggctgaaaaaggagtatcctgatgtagggtgtactttggattatgaccaggcatggaaactgctggtgagcgtgcgtctggcggcacagtgtacagatgccagagtcaatgtggttgttcaggatttatatgaaaaatatccggatgtgaatgctctggcagaagcagatccggcggacatagaggcgatcgtcaggccgtgtgggcttggacgaagtaaggcgagagatatcagtgcctgtatgaaaatattgagagacgaatacggcggcggaattccggataactttaaggctctgatgaaacttccgggggtaggacgtaagagcgccaaccttgtgatgggcgatgttttcggagaacctgcaatcgtcacggatactcactgcatccggctggtgaaccgcatgggactggtggatcagatcaaagatccaaaaaaagtagagatggcactctgggagatcatacctcccgaagaaggaagcgacttctgccacaggctggtatttctcggaagggatatctgtactgcaaggacaaagccacactgtgaggtatgctgtctgaaggatatatgccccaaagaagggttatagtgtcgggacagaggactgggaggaggagccggcatgaagaaacaaaagttattcaaaaccaatgctgcagaaaggtgcatcgggaaggtcttgtcaaaaaatcaggttgccatgtatgcctttttcctgttggatattgataactttaagcaggccaacggccggttcggccatgtgtttagggatatggctattaaagagtttataacagttatacgagggcatatccgtgaaaatgatattctggggcggaacagactttgtctcgctgtataatcatgcggatgcggctctctacaagacaaagcagagaggaaaaaacggatatacaatttctggccgatcataaactgtatggagaagggagtaaatcgtactgtgatttactcccttattttaatgctttcttttgctcagaagagaaagaggaaatcgtttcctgaaaaggggaagggactttaaccccacgggttctggtttccatctggcatagagcgtgtaatgctccgtgcttccgtgggggatcatatttatctgttttccgccgaatggatcgtcataccatccgaggaaggcaaggcccggaagttcttccggaggattcaggatgagatcaggtgaatctgtcgtataaaaaactgggttggtgtttgaggattccaacaggttctcatagcgtatcctgaaacggacgggagccagcaggacaaaagttcggtcaggatttagacgaaattcccagccgttaaacctgtgggatggcatccgaaatttttcggcgtccgaaggctgaagaccgaaatattcggataaaggggcacagatgacgattggatttccttccttgtttggagaaatatattcggaattctcaagacggatacatgcattgggatggagggtgttctgcaggtagagatgagtatcagcatctttgaggaaaaagccgtcatataaatttggtccttcctcaagaataagagaactgccgcattcaagagagataccgactcctgctttcttggcaaggttttgtgaaagccgtgtggtgcctcttaaacttacaatattgccaaagccatgggacaggataccgccgccgcacccaaaacgagccgtattgtcctcgatgatacagtcatataggtttgcatccgcagcgccttctttggaatcaagaaagattcctccgcctgatcctgcctgatttttgataaactctgacgatgtcagggagagattttttgctttagatgaagactcagacagaaaggccagcccgccgccggatttttttgcggtgtttctggaaaatgaagtctgtgacacattgacaatgccgctgccggatgaactcatggcaataccgccgccgtcagaagaagaaatattttcaaaaatcctgctgtctgtaaggtgaaaggaaaattctccgctgcctgcactaaaaacaatgcctccgccgcaggaagccgcccggtttccctttatatcagaattcatcagtgccaggcggacagatttttttgaagaacgattagtgagtgaaatgcctccgccctgtccatcggctttgtttttggaaatagaacattcatttactgtaactgaggcacctgtttgggaaaccaggcagagacctcccccgttttcttttgcactgttttcagagaggacagagtccttttcgatatccagctgatcttcctcactgcagccgaagaagtaaatacctcccccgtaagcagaggcatttccggagatcctcacattacctgacactgtgagggaagaaggtatttcagcatcttcacggaagcctgagaaattgatgccgccaccgcatcccagggcaatgttatcagttatggctgacgagtcagaaacggtgaggatgcttcccgcccgcttttcaaaagagcgaagatagatcccggcgccgtgggccgcagtattgtgggtgatcaaagcgcgtcccaggattgaaagtttatcatcgggatgtttgacagcggccataacagctcctccgcagagtctggaggagcaacccgaaatctgcgaatcttcggtcatcaggaaattgtttggaagggaagcgatgcctgaaaaataaacgcctcccccttctgtataggaatggttgtttcggagaactgtaccgtgtttcagaatgagcgtaccgcccgaaatcaatattaaggaacggttcataggatctctgcctgaatggagttccttttgaccgtctaacacaatgttttgaagggtgaggctgcctccttctaaaacatgaaacatagaagagggaaaggaagcatccttataaagggagaccggacattcatcggaacagccagtgagtgtcagggaacagcggacagtgatctgtttggagactgtgaaatctgagactgcctgaatgtgagtttctttggaagccacagcgttcagaagctcagtttgattggagactggagtcaaaatatcacctgcttttttcagttcaatcttatatttagtatatgcagaaataacaggcaaggggaatggtcaaactcgcccaaattttcaggtaaatatacttttaatattccaatttcatctaaggccccttcaggagcatatgagatatctggtgtaaggattgctgatcaggccggtgatttaaatcaaaaatgtgtcataaacaatggaaataatagaatagacataaaagatgagtttgatgttgactttcaatatttcattaacaatccaaacattgtatctaaactgaaatccatgcagacaggaaaagttgccatgatcaatttccccaacagcagctataccgcaaagaaggctttctttgatgcaatcaaaggaaaggataaaactattgttttttcaaatgatggtatcctatccagcaggctgaatctctattatccattgaagaaactgaaggcaaaaaaagatattatgtaaaagtccgcgcattgaaaaatataaagaaaaatggtgtgcataggaaatggccatgcatgtacatgaccatttccggcactttattttagatatttcatctgtctacttgacaaggggctgatcacaaacctaatattttggatgccgccttaaataaatttacttaaaacattttatcctgtgggaacagagattttacatgatctatttcttcctgagtggcaggtgctgcaggaacataatactcacgttctctggcaagcttataaatctcttcctgagacatttcacactggttcctcatctgttttaatgtctgctttaattcctggttttccgactgggcgatcattccgccgtaccttgtcagctctccgtttacgccggcaagcgtatcggctaccattgtcttatcatctaacattttgcttcctccttacttaagaaactgcattaatttttgtttactgtccattgctgactgagcggattgctgaaagaattttttcagagcgggatctgtcgcctggtctgcataagcctgcattttgcagtgtgtggtgtcaaaaccgccgattaagtgacgaaggttctgtaaatctaacatagatatatttgccattgtaatgcctcctttaaaatttattacctctttagtatcccaaacaatttttatagtatgcgaaatgaaaacagctgtataaatttgattgattttgtaataaaatttaattaaaaaatgaatgaattttttatggaggttttattttgaggcatatctatcaatgggaaaaggcagaagcagaaaaattttcaaaaatttataaactgatgacagaggcttttccgccaagtgaaataaggaatgaagaaggtcagagaaaccttctcggccgttcggcgtatcagctttatacagtgaaacaagaaagcgaaatccatggccttctcgccgtgtgggagtttgacacattcgtttttatagagcattttgcggttgatgcatccttaaggggaaatggaatcgggggaatgctcctgaatgattttttgaataatacggaaaaaacagtgtttttggaagtagaagagccgggaacagacttggcaaggagaaggataggattttacgaaagagccgggttctgcctcaatgattttgattatatacagccggatctccagcagggacaatcctctctgctgctgaaaaatatgacatatccaaagaagtcatcgaaagaagattttgaacggatgaaacagcagatttttgagacagtgtatgagatacaagcttaaagatccccacagggcacaccctccgagtataagattgattctttcttgtgatactttataggagtagatttttaacctacagtatataggggggaatgaatttatggaatcaggaaaacatcgtgtgtttggatatgttagagtgtctgccaaagaccagaatattgaccggcagatggtggtcatggaaaagctgaaaatactcaaaaaaagtctgctttaatcaccaggcgttctttacggacaaaagtacagggagatacagagaatgggaggatatagaagatggcagatcagggactgttggattttttggaagagaaaagcagatgtgcatatctttcggaactcagagacaggcagaaagacagagaaataagccggattttgaataaaattgatgcggaaagcttcagtacaaaggactggcaggatgcattggaatattttacatatgtcaaaaaagagattcaggataaaaaaagtgcaaaagcgtatttggaagaatatttttcaggaaaatacagtaaataacttcacaaaattatatttctgcataatataaaagaaaaaggaactgtataagcatgagcttttgtgaaaatatatgggattcggatcagggagaaacaatcaatatccagggcgggaccattgaaaatatcatgcattcgggtgacgcagattacgtcaaaacagtgtgcagacttcagaaagacagcagaattcagtccgtcgttgtaatgattgtggatgagcatacattgatccactgcagcgacgggaaaagaattacttccagggatctgaaggaaggcatgacggtcgatgcctggatctcaaaggctatgacaaaaagtattccgccccaggccagggcatacaggatcattgtgaaaagcaatccctgcgggacagcggttaccgacgggagagtggcaggggttgatctgcacaacggtttcctgtacacaggaatacccggaaaaccggaaagccagatccgttttgtagtcacagagaatactccgattctggaccgccagggaagcagaatacggcttagggacttaaaacagggcgaccgggtacgggtagaacatgctgattttatgaccgcaagcattccgcctcagacgaccgcatttacgataaaaaaatattagcaaatattaagaagcagacagcatttttctgtctgtttcttctttttccgggcaaaaatcaagaatcagtgttataataaaaaggctatagaaaggaggcccggggtatgagaacaagaaaagaagtgattgaattctgcatgtcactgaagcaggtttatgaagactatccgtttcatgacagcaactggacactcatgagacatgagatgaataaaaagacatttgcttttatttttgaacgaaacggacatatctgggttaatataaagtgtgatccggagtggatcttggtatggagagagacttatgattctgttgtgccggcctttcatatgaacaaaaaatattggaattccatcattcttgacggttcagtgccggatgaggatatcaaacgcatgatcggggagagctacgatttgattcaagcaggcataaggaggcagaaatgaatacgagagaagcaatcaacataagatgttccagaaggacgtaccttccggaatatataagggaaaaagatgcaaagccgttgtttcagatgatccgggaaatcaataaggaacaggggctccatctgcagctcatcacagatgagggcaacatttccaagattaaaatgagctacggcatgtttaaaaatgtgcatggattcattgcaatggcgggcagaaaagacgatcccgatttaaaagaaaagctgggctattacggtgaaaagctggtccttttggctgctgctaccggactcggcacatgctgggtgggcagtacatataagaaggacagctgtgtgtgcgatttagaacagggagagagccttgaggcggtcattacggttggatatgtagaggcggataagaggacgaaagaaaagatgatctcttcttttgtaaagaaaaaagggaaaaaagcagatcagatgctcaagacagaagaaaagattccggactggatcatgcaggggatggaagcagttgagaaggccccgtctgccctgaatgcacagccggtggaatttcggtggaaggatggaaagtttacagcccatgtgaaggtcaaaaatggatttgaagagattgatatggggatcgcaaagcttcattttgagctgggaacggaaaaaacaggatactgggaattaggaaacggagcagaattccgttattgacagagaataaaaacaggatggatgatcgatgagcaagacaaaattttcaacgctgtgttatatagaaaaagatgagaaatatttaatgcttcaccggaccgtgaaaaaacacgatgttaataaggacaagtggatcggcgtgggaggacattttgaatacggagaaagcccggaggactgcctgttaagagaggtaaaagaagagacggggcttcatcttacgtcatggaagtttagaggtattcttacgtttctctgtgacgactggccgatggaatacatcagcctttttacggcagacggatttaagggggagttgaccgcctgcaatgaaggggtcttagaatgggtggataagaaggatattttggacctgaacctttgggagggggacaagatcttttttaagctgctggctgagaatggacctttcttttcgctgaagcttgtctatcagggggactgccttagacaggcttgtctaaacggcgaagatatggaactttttgatatattgacttcggacgggaaacctacagggatcgtaaaggaaagatcaattgtgcacacgggcggtgatctccatggaacttcccatatctggctggtgcgcagaaaacaaaacggatttgatgtcctgctgcaaaagcgcagcaaagaaaaggacgcatttcctgggtattatgatgtgtcatcagcaggccacatggcggcaggggatgattatctgaacactgcggtgcgggaactttccgaagaactgggagtaacgacagagccggaagaatttaagtttataggaatgagagattccgtcgtaaaggatatctttcacggaaagccgtttcataaccatgagctgagtgcagtttacgtatatgagacagatcttgcggaagaacagttccggctgcagaaggaagaagtggattctgttctctggatggacttcggagaatttgaagaaaaagcccggaacggcgagatcagacactgtattttcgcggatgagatcaagatgctcggagagttcatggggtgtaaataataagaggagcgatactgacaatggatgagagtgtgtgaaactttttctgtaaaatagaacttagaaggttcttctatgataaaataaaaatcataggagggccttttattatggcaagagaaaagaaaccagtgcacaaagtacaaatgacagaagggaaacgcaacatcatccatcagctcctggaggaataccatatccaaacagcacaagatattcaagatgccctgaaagatctccttggcggaaccatcaaggaaatgatggaagcggaactggatgatcatctgggatatgcaaaatcagaacgctccgacaatgagaattaccggaatggatacaaaccaaaacaggtaaatagcagttatggttctatgcagatccctgtgccacaagatcggaaatctactttcgaaccacaagtggtgaaaaaacggcagaaagatatttctgatattgaccaaaagatcatttccatgtatgcaaaagggatgacgacccggcagatatcagaaaccatggaggagatctatggctttgaaacctcggaaggatttatctctgatgtcacagacaagattctgccccagattgaagattggcaaaaccggccactggatgaggtctatccaatcctatatattgacgccatccactattctgtccgtgacaatggaatgatccgtaaacttgccgcctatgtcattcttgggatcaatgcggaagggaagaaagaggtacttacgattcatgttggagagaatgaaagctcaaaatactggctgtctgtattgaatgagctgaaaaaccggggcgtaaaggacatccttatcatctgtgcggatggtcttacaggcataaaggaggccattgctgctgcattccccaaaacagaatatcagagatgcattgtccaccaggtgagaaataccttaaaatatgttccagataaagacaggaaggcgtttgcagcagatttaaagacgatctaccaggcatcagatgaaaagaaggcccttgcagcccttgaacgtgtgacagagaaatggacacccaaatatccgaattcgatgaaacgctggaaggacaactgggatgctgtttctcccatcttcaagttttcagcaaccgtcaggaaggtgatatacacaacttataccgacaaaaaaactataccgacatttccaggaatcccactgcatacagatacttttgaaaaaatgtcggcatagttttgacagccgtaaagatatacttcatcatgggaagaaaaggaggttcctgatgatgaaggataacaaaagaaaactagatgatctggttgtggaagtaatggggcaaatgaagaaaagaaagtatggcgagaagatatcttcccattatcgttccagtttttcgagcctcaagtctatatcagaagacattggagaagagtatctctccgaaaaactcattgaatcctttttagatagtccagtgggatgcagtgaaaagtgggggaaaaaggagcggacacaccggctacgttgtatcagactactaaagtcacttgagcaagacggctctattgattggggaagacaaaaaccagaaagcctatccggcgcaatcattataaatgttttccgtatggatctggaacgatttatcagacagatggaagatagagaactccgtccgaataccatgtatggatataaacgtattgtcacatatttcctgattttttgtcaggaaaacggatatacatctctgtctgatgtaaaagcaaatgatgtgaccagatttatcctgtcgctttataatgatggaagatttcggccaacaacaattggaagcgtactctccgggtttcgtgaattcctatctgcgaatgaatctacagaaagattttctatggagataccagtgcatcttccacgggagacaaagattatagaagtttacagcagtgaggaacttgacgctatagagaaactgctttcgtctggaattatgaccaggagagataccgctatctgccggcttttgttggaaacagggctgcgcggaacggatgtctgttcactggaattgaagaacattgactgggagaaggatgccatttacattgagcaggacaaaacaaaaaggatgcttactgtaccgctgaaagcttcgtatggaaatgcgattgtggattacataatggaggaacgtcccaaaattgaagatacacatgtattcctgagaagttttgcaccattcaaaaagctggaagccggagctgtatggccaatcttacaaaaaatggagaacatggccggaatacaaaagaaaggacgagtgagcggaagcagaatgacacggcataacgcagcgtcctgcatgctccgagccggtgttcccatgtctgatatttccgccgtactcggacacaaggatccaaacattgtctctgtgtatctttcaacagacgcatccagccttgctgcctgcacacttccgcttcctgctattcggaaaggaggagatcctaatgcagaatgattccctccagactttaattgatcagtttatttcttataaaaagcagaatggatatgcataccaaagtggggtttattatctgaagaaatatgctttatctgttttagaaatggaaacagcagtgatagtaccgactaaggaaagtgctgaaatattccttggaaagtatgaaaatgccccgggaagtctttacaatgctgccgcgtttttacgtgaattcagcaggtatctcatagcacgcggatattcagaggcatatcttatcccatctggaagaatccatcttccaacaccagtccagccatacttttttacagaagaagagatcacggcattttttagtgaatgtgacaaggttatggataatccgcattataaaggccgccacatagtacttcccgcaatgttccggttactatactgctgtggcctccggtgtaaagaggcccgcattcttgctcgggaaaacgtacatttgggtgaaggatatcttgatgtccttcaatcgaaaggctcaaagagccgtagagtttatatttccggagaactcagggattatctcaatacttatgatcttcggatagggcagttgtttccgaaccgtaagacgttttttccaaaccggtatgatgccccatatggcgcgtccatgttagaaaagaactttctgcgtttctggtactctgcttttccagaaaaaaagaattccggtatcagcatccgcgcgtatgattttcggcatcattttgtttatgcaaatatgaaccgctggcttcgggagggaaaggatgtaaatgccatgcttccttatcttatgcgctatatggggcactctgacataaaaaatacactttactactttcacctgataccagatatttatggttcggtcattgcaaaatccggtcattcggaaaaactgataccggaggtgtgggatatttgaaacgaaatagagcaaaagaccatgatagtgttttcttctgggagacagccgcatgttttctgaatcatgagttgcccaaaataagaaaaaagagtacaaatacagttacagcttaccgcatttcgctaaatatctgtattgattatctggaagatgtgaaaggaatccaacgtgaaaaaatatgtttttgtgatctgaaaaaagagaacctgaaagattttcttgtatggatgggacaggaaaaaaagtggagtcctaaaacctgcaatctgcggatgacggcagtaagatccttgttatcttttgcggcagaagagtgtatggatatcacttatctctttgcggcaagtaagaccatacgcagcctgaatgttcccggcagagagattgaatatttcgaagatgaccagctaagtggaatccttgaggcgcctggaaaggaaaaacgttccgaacgcaggaaccgaatgctgctcattctaggatatgacgcggcaatgcgggtgggagaattaatagatctgaacgtagaaaatattcaccttgatgcggaaatcccttatgttcggatacttggaaagggagaaaaataccgtagcgtacccttaatgggaaaaacagtagaacatctgcgtaaatacctctatgagttccatggagatatctcagatccctcagcgcctctcttttatgctgtcacgcacgggcggatccatagcctttctgatgactgcatacagaaagtgttaaaaaaatataccgaaaaatgccgtgtaaatgggatccatatgccagcaaatgtgcattttcatatgctaagaaaaacacgtgccatgaacctgtatcaggaaggttgcccactatcctatattcaacagatgctggggcatgaaaatatttctacaacatctgggttttatgctttcgtaacgttgaatacgcttgcggaagcaattggaaaagctaacccagacagaaagaatactgaaaagagttggaaaaaagcagagacagcaaaaatactgtataggctataagaaaaactatgccgacattttttcaaaagtatctgtatgcagtgggattcctggaaatgtcggtatagtttttttgtcggtataagttgtgtactaacacgacatcgtgttagcacaaccaatgccatagaatcactgaattccacttatcggaagctgaaccgccagagaagcgtattcccaagtgatacggcgctgttgaaagcgctgtatttagcgacatttgaggctacaaagaaatggacggtaacgatgcgcaactgggcacaggtatatggggagttaagcatcatgtacgagggacgacttccagagtaattcaaagacggcctaaaacgggcggatttaccgcctgctgttgacatgtttttttgtaactgttatatataaagtaagggcgaaaagcctgtttttcaagactttcgcccttcattatcatagaagaatcttatttacagactttttttcatagtctcatggatgagtcagttccgctccttttctaagtaatagttgtcaagcccctcaaagagtgaggggttggggagctgaagtgggcttgcccactttgttctgctattttatcagctttttgatctgtgcctccagggcactctcttccatagcgcccctggctccggagacaatttctccgtcccggttgataaagtaggttgtggggagagattctgcctgatagttataggcagcttcctgttccgtgtcataataaacagggaatgtatatccctgctctttgataaaggaggacgcttttttctttgtctcccttgccccgtcggtcatgttgaccatggcaaaattgactttgccggaatatttcttatacatggcctcaaaaccgggcatctcctgtttgcacggcggacaccagctggcccagaaatttaacacaatgggttttttgccggtcagagaaaagaagtttatcggctttccgccggcatcctctgcgttgaagtccggggcagtgacagcttcctgtttttctgtagcatccccggaagatgtttcttcggatgcagtatctgccttatattttttgctcaggttctggtagagaacaaaagctcctgctaaaagtgcgatgagtatgataataatccctatcagttttgtttgttgtttcatagatccctcctaaaatgtcaagattgataaaaagcggtccatcattcccaacatcatcaaaagtcccacgataatcagcagaattcccgaaacttttgtgatgatgccgtagtgcgatttgatccagccgaaagcccccatcagacgctcaatgagcacggcgctgagaatgaacgggatgccgagacccatggagtagagaaacagcatgaggatgccttctgccatggagccctgctgtgacgccatcatcagtgcagagccaaggaatgcccctacacatggggtccagccgatggaaaaaacaattccaaataagaaagatgatgcatgggtatgttttttcacttccatagaactgcgttttgtcctgtttaaaaagcttatgttaagcgctccggtaaaattcagaccaaagatgatgacgatcagtccggtgattatgttgacaatcattttatgtgaagtgagcagccctccgagagttcccgcgaaggcacccagaaggataaaaaccagggtaaatcccgcaacaaacgttatggcattaggcaaggctttgtgtcttgggcggtctgttgtctctcccgcaaaataagaaatatagatagggagcatcggcagcagacagggggatataaaggttacgatgccttctaaaaatgaaattaaatactgcataaagtctcctggatgttaaataagtcgttgagtgcctcgctcatggtcggatgggtgtagattgtatctctcagcacggtatatggaagatgtgcatccatagcgagtttgatcaggttgatcatttcgtgggattcggcgcagaacagatgagcacctaaaatctcgtttgtcttcgtatcgattacgacttttaaaagcccggttatttacgtttcgttttttatctcccagaatctgtgatttcacaatgtggaaatcatccagggaaatatatgtgaactgaagacctccgaccacatcacccatggcatagatgcccggaacatttgtctgaagaaattcatctgtcctgacagcaccgctgggagtcaattccacaccggcagcttccagattcagatcgtttacattagggcggcgtcctgtagccacaagaacggcatctgctgaaattttttcatcgccctccggtgttttcacagacacaatcgttttagcttcttcatcgcggacagagtttatttttgtggagagcagcagctttactccgcgttcttttaagctctctgcaacagcatcggcaatatcccggtcctccctcggaaggaatacttccccgtcctggatgacagtaaccctggagccgaagttcgtgtagatagaagcaaactccatgccgatatagccgcctccgatgatgaccaagtgtttcggcagttcctccaaagaaagcatggtctcactgatatacgcacgccgactgtcagagagaccctcaatgggagggataaacgggcgagctcccgtatttataaaaatctgatctgcttccagttccagtgtctcagcctgtaacgccacggccacatgcctgctgtctataaaagaagcggttccgttataaacatctgcattttccaggtctgcgaccttatggtagtttttatcccgtaatgtatctgtcagctttgtctttttttcaacagcttcccggtacagccttgccttttcttcaaaagaagaatcaagctttgcagaaaaagctgcactcgcaacaaatgatttggatgggatacatccaacgttgatgcaggttcctccgtacatgttagaatccttttcaataagagcgactttccttccatttgcggcaagcgtcattctcctttaatttggatgaaccgaagatcttttgatcgatggtctgaatggttacctgtttcaaatgatctttgcataactgatccaggctgccgtaaatgtcatccataatgcctgccattccggaagccaccagacagggcagatcgctgttgccgctccgccaggaagacgagacaaacggaacattcagggcactgctgatatcataaagggttaccttggatggctccaggtcaaacagatatcctcctactaccccttcttttgtagaaatcagtccctttttcttgagtttccccatgatcttccggactcttgccgggtttgtgcagatattggcggccagcttgtcgctggatacgctttctcctttatggtttaaaaaaacgagtgcgtggactgctatcgtaaattcactgttcataagttgatttcccctctgtcttattctatatgtaataatttgagttacagtttatgctgtaatcatatcagttacatttgtgaatgtcaagaagaaaatatggaatctgctgaaaaaccgtggtacaatgaacccagtgaaagaaccagcgataatgaatgtgacagggagactgcttatgatattgagtgtcagcagaaggacagatgttccggctttttatggtgaatggttcataaaccggcttcgggacggctccgtgctcgtgaggaatccggtgaatccaaaacaagtcagcaaaattctgctttccagagaaaatattgactgtatcgtgttctggacaaagaaccctgaaaatttcatgaagtatttaggagagctgaaagagtatccgttttattttcaatttacactcaatggatacggaaaggatatagagccgggaatgcccgataagaaaaaagaattgattcccctgtttcaggagctgtccggaaagatcgggaaagagagggttatatggcgctatgatcctgtgctgatcagcaaagactattctatagagtggcatattcatacatttgagtccatggcagaagccctggagggatatacaaaacaggcagtgatcagttttttagatatataccggaaaataaaaagacagatggcccaggcgggaatccgccggcctgcagaggaagaagtctttcaatttgcacagagagcagggacctctgcgagaaatcacggtatgaccacggtgacctgtgcagaaggttatgacctttcatgttttggcatcaggaagggctgctgtatcgacagagaacttgtggaaaagctcattggaatgaagatttctgtggacaaagataaaaatcaaaggccggagtgtggatgtgcagagagttttgacatcggaagttatgatacctgcccggcagactgtctttattgttatgccagccacagcagagaaactgtaaatcaaactgcggcacagtaccggccggataccccgatgctctgcggagagccggatcaattcgataagataacggaaagaaaagccgaatcctgtgccattgcacagctgagtttttttgaggaaagcctggcggacaaatgaggtgagtttcatggatgcatcggaaaaaacaaaatataaactggcaggcgccgtcagggagctgatggcttttacgcctgtggaccggattacggtaaagcagatcgtagagcgatgtgatgtgacaagacagacgttttacaggaattttaaggacaagtatgatctaatcaactggtattttgataagcttgccattgtatccttccggcagatgggcgtgagccttacactcagggaaggactgatcaagaaatttgaatttatcaaaggagaacggtgcttcttcacggcagcctttaaatctgaggatcacaattcactgctccagcatgattttgattttatctatgaattttacaccgacattataaaaaagaaatatcagagagagattccgccggatatcgagtttcttctggaaatgtactgccgggggtccattgccatgactgtacagtgggtaaccggtgggatgaagcggagcacggaggatatggcagaactgctggtcagggccctgcctccggaacttgcagagcttttgaacgactttaaaaagtgacacttttaaggaagtgtcacttttttgacattatgggaaatgtgtcacttgtctgcctgttccgccgggaggtaaactgataatgaaagaatcacgataaatcaaaggtatctcaaggaggttgttatggcaaagcgtattgtattgaatgaaacgtcctatcacggaaaaggtgcggtccgggaaatcgcagcagaagtgggagcaagaggcttcaaaaaggcattcatctgttcggaccctgacctggtaaagttcggcgttacgaagaaggtaacagatgtattggacgaggcgggatatgaatatgaggtttactctaacattaaaccaaatcctactattgaaaatgttcagacaggtgtcgctgcatttaaggagtcaggtgcagattatctgatcgccattggaggcggatcttctatggatacttccaaggctgtcggaatcatcattgcaaatccggaatttgaagatgtgcggagtctggaaggcgtggcgccgacaaagaatccgtctgttccgatcattgcagttccgacgaccgcgggaacagcagccgaggttacgatcaactacgttatcacagatgtagaaaaaaggcggaaattcgtctgtgtagacacccatgatattccggtcattgccgttatcgatccagacatgatgtcctctatgccgaagggcctgactgccgcaaccggaatggatgcccttacccatgcgatcgaaggatatactacaaaagatgcatgggaaatgacagatatgtttcatctgaaggcgattgaactgatcgcacagaatttgcggggcgcagtggaaaacacagaagagggcagagagggaatggctctcggacagtatgtggcaggaatgggattctcaaatgtaggactgggaatcgtacactccatggctcattcactgggagcagtctatgacacacctcacggtgttgcaaatgccattcttcttccggctgtcatggaatataatgctgatgccacaggggataaatataagtacatcgccaaggccatgggtgtggaaggcacagaagacatgagtcaggaagaatataggaaggctgccgtggacgcggtgagacagctttccatcgatgtgggaattccacaggatctgaaagaaatcgtcaaagaagaggatattcagttcctttcagagtcagcggcggcagatgcgtgtgcacctggaaatccaaaagacgcaggtttaaaagatattattgcaatctataaatctttactttaagaatttacgtaaacgaaatgaaaggactggcgcacgaaaaaagtgcggcagtcctttttgcaagattatttgccgttttgaattttatcaaagaaatcttttgtcttcagagaaaaagaacatttttctacctcggcatttgtcagaaaatctgtataaaccccatagacaccgagtttcatatattctttggcttcatatacactgttgacagtatgtgtgaaagaatacaggcctgcatcatttagcagcttcatccggtaatcattgacactgctcacagggacagtgacagcttcaatgccgttggcagtgcagaacctgatcatcctgctgaatgccacatctgtctgctgataagtggtataaaggaagtgacggaacggatgaacctgttttatggcatgatacattggctgattgtaaatctgtacgattaaccggtccagaaggtattctttcttcatttcttttgctgtctttacaatgacagagaagtcattttttgcggctgcggcatcactgtctttggtgtccgtcataatatatgtatcaggatatttgtccatcagttcaaagagttcttttagtgagacaggagtgtatttgccgtacagcttaatatttttaaacttggcataggaaacaggtttgcctcccttgctcttcggatcactcaagtcttttccccaataatgccttgcgaccatgacatgatccgcagtctgcatcaggtcagcttcaaaaaccctgaaaccattttgataggaatttaaaaacgcatctttagagttggtatactccttaccatcgatctctccaagagcatgggcaaccgcgcggtgttcataccactgctgtggtttcttcttttcctgcccggaatcttttttctgagcagactgatgtttggcttcatttgcggcattcacttttttctgccgatcctggtaaaaatgaaacccagtaaaaatcataatcccaagaaagcaaagaaaagacagacgcagtgtgattcgttcaaatactgcacggatatatctcggttgatgctttgcttttttaacggcgtttttgacagattttgtttttatctttttcttgttcagcatgaaaccttcctttgtaaaaaagatgtaatataattgtaacaattatgttaaaagtattataccataggaagaccaaaaaatcaaaagtatatcagcagtatgcgtgacaaagttttaacattcagaggtggatttccggcagagcttcatggtatagtaaatgtatcgatgctagttaacctttcaaatgattcagaagaatcaaaggatttaaggaggaaatcactatggcaagtattatcgcaagtccaagccgttatatccagggaaaaggtgagatggaaaacctttgtacatatgcggaaaactatggaaccaacctttttgttctgacaagtccgtccggaagaaaaagagtggagccttccatagcaaaagggcaaaaagatgccaagattacatatgaagcttttaacggcgagtgctgtatgacagagatcaaccgtgtcatggacatttgtgaaaaggccggaagcgaagtcatcgtcggaatcggcggaggaaagatccatgataccgcaaaggcagtggcttattacatgaaaaagccagtcatcattgtgccgaccattgcgtctaccgatgcgccttgcagtgcactgtctgtgatctatacggatgacggtgtctttgaaaagtacctgtttctgccggcaagcccgaacatggtgctggtggacaccgacattgtcagcaaagctccggaacgccttttagtagccggtatgggagatgctctggcaacctattttgaagcgagagcctgcaaacagtctgacgcatccaactgtgtgggaggaaagatcacacgcgcggccatggcactggctgaactttgctatgaaactttgattgatgaggggattgatgcgaaacttgctgtccgtgaaaatatctgcacgaaggcagtagaacatatcatagaggcaaatacctatctttccggaatcggatttgagagcggcggtctggcaggggcacatgcgatccataacggcttaactgcaattccggaaacccatgaattataccatggagaaaaagtagccttcggaacgctggtacagctggttctggaaggggcggatcaggatgagattcaggaagtcctcggattctgtcaggaagcagaactcccgactacccttgcagacttgggaatcaaggaagtaaaagaagaacagatcatggaagtagcgcgtctcgcatgctctccggatgacactctcggcaacatgccgtttgaagtgacaccggaggatgtatatgcggccatcattgcggcggacgcgctgggaagatattattaagcttcctgcctttggcacagatgtcttcctgcgaggaagcacacggcacataacagaataaggactgcggccatcagcagggcgcagtgaagaaagaaggcatccggcaggatggtgatgacagggtcgaaagcctcatcgaagatccagtaatcattggagaaggccagctcgtgaaaagtcacgaaggccttgtcccatccggccgcccagaccagagctcccaaaaggagcggaagcacggcggcagagacggatgccttttttaagaaatggaaatcctttttttcccgcttccataaaaggcctgcagggattatgataaatgagatgatacaggcgtattggaggccggagaaaatacgctttacatcctgaaagtgaatctttccttcctcagacatgggaagagagggaaacttcaggtcttttttatacaatacagaattataatcaatgagccggtcatagttttctctgatctgtttttcagagagcccggattcccggctgatatgaagaagctttatatcggcatagtaaaggggccggaaattcagtgtaaatacgaccgaaaatgatatcaggaaaatagataaagaaactgtaagcagaaattgtttcatgatgcaccgcctttcatgaaacccattataacacaaggaagtaccatgatagcgattatttcacctgcaaaaaacatgaaagtcaggaaagaaaaacagcgaaagctgacagagcctgtattttcagaaaagacaggacagatttatgaagaattgaaaaaactgaagccgtgggagattgaatctttgatgaaggtaaatgaaaagattgcaattcaggcttttttagatatacagaattttgaaaatggggacggaagtgcggccctcatgacttatgacggcctggtatttcagaacgtgggcgcaggagattttaccgggtgggatatgaaatatgcccagaagcatgtgagaatcttaagcggaatgtatggagtgctgaagcctttagatgcgattcatccgtaccgtctggagatgggatgcaaagtagaaacagcgggacagggtctgtaccggttttggggagatgcgatatataaggagctttataaagaacaggatctgatccttaatctggcttctgaagagtatgccaaaactgtgaaaaaatatctggatgggccggatcgttttgtggacgtggagtttctcaccatgagaggcggaaaactccggaccatcgtggcatgggccaagatggccagagggcagatggtccgtcatattgtaaagaacaggattgaccggccggaggatatcaaagagtttgactgggacggatacgagtatgaaccttccctgtcttctgaagccaagtatgtatttatccggcgggagactaagctttagttgacgatcaggaatccaaggtttaaaagcgccgcaaacaggcaccagacaatgtacgggatcagaagaaaagcagattttttgctgtactttcggaatacatagaacattagtgcattgagcagattcagagccagaatccagacaaaggagaaaaagaccagtccgtattcaaagaaaatgatgggccagaagaacaaaaagaaggacacggcgagaaaaagcttgattccctgttttttctcctgctctgtgatgtccgaggtcagcagggtgtaaaggctcagtcctagtaaaatatcgaggatcagccatacgacggaaaagatccacggggcaggaacgaatggaggcttattcagctgacggaaaatctcatccatccggggtgtcaggagtctggagagcagactgaccaaaatgggaaaaatgatgcagagttttaaaagctgcttcgttgataattgtttcataacacacacctggggctttttacatagtctatgcagcaagggttgtatatcttgacaaaaaaagatattataatgagaaaaggagtgatgtgagatggaattaaagtgtcctaaaatatatagagacggaaaatatctggcttacggcggcaaccaggaatggtttccaggcactttccagcgccgtgcgggatgcggaagcgtcaccggcacgaatatcgccgtctgtgaaggtttattttcggaagaagtagaaaattcagagtcgataccccatgaatcatatttagaacttatggaaggcatgtatcagtatatgacgcccggcttcatgggctatccgctgatcggaaagtttaaaaaagattttttaagctttgcatccgacaggggaaaaaaattaaaggcaaggagcatgtttctgcccaggaataggcaggactgtctcgattttattaaggaagggttatatcacgggcaccccacagcactgctgatctggcgtcattccaggaaagaattcagagaagacaactggcactgggtgactatcacaggatatgatgaggaacgggaaatcctgatctggtccaactgtggggaaagggaagaaatccctgtgaaagtattgctggatgactcggcgagatactatatcggattggtccgttttgaagaaaataattaaagggttccgatttttacaattcatatgaaaagaaagagagtaagctgtaacccatcagcaagaaaccaagtaaattaagagatgggaacaaaggcgttcaccggatatatccggcggacgcctttcttttatgaaaaggagtgatatgtatggagaatacgaagaagttgggactcggaagtgcggtatctgtctgtgtagggctgattgtggccaccagctgcctgctttcccttgggcagggtatgggccttgcaggtaaaagctttattatcccactgtttgtcgtattgatactgaatgggtttttggcgttaagctttcaagaactgcattccatgatgccgaaagcggaaggaggcctgggacagtataccctggtgggactggggccagtggcttccatggtatcgaccttgtccgcctatgtgattgttgatattctatccggttccgtggaaatcgccatgtgcggaacggtactgaatcagatctttctgcctcaggttccggcaccgttgatcagtgtgatcatattgggggttttatcctatgtaaactataaaggggttgattttttcgcccgaatccagaacattgtcgtattccttctgctggcatcttttctgctcatgggaatcataagttttttccatctgggcaccggcgagatagtgacggctgctcagcagacgaagccgcaggttaccgggattggaggaatcgtttctttatcagcattggcattctggctgtttatcggaattgaattcgtaatcccggtgtcaaaggatcttaagaatcccaaaagagacgtacttttggctatgatcattggcatcgtcgtcctgttcggagtgcaggcgctgctcggtgtggggatgacacagtatgtcacactgcaggaactggcgtcgaatccaatgccccatatgctgtttgcagaacggtgcatgggccaggccggagtttactggatgggcatcgtgacactgctggcgggaatcagtacagtcaataccgtcctcggaggcatcccgaatattttaagcggtatggcagaaaatcagctgtttccgaaggcctttcaacagaaaaacaagtatggggttccggcagcaggaatcggcctgctgagcggaggaatcacggcattgatcgttaccggatttacccagtcttcagggcttacaaatataatccttgcggcgtcctgcttctggctgacttcttatattatggttaatatcacagtccttgcgctgagaagaaggtatccggatgccgagggcagaaacaagaagctggttcttctcggtatccctcaggtgatctgcattatcggtgacatttatatgatctttaacattgccgagggtgatgccagaatcctgatttataaaatattcgcgactctgctgctggcactgatcgcattctcagtgatctgggtaaagggaataaagaaaatgggtacggtcgaatgtccggaaatgcaaacggtgaatactttggcatgagtttttcatcactatttccgtcacgctttgaaatgcgttcctccaatagtgataaaaaactatcgtaaaatgtctcactccaattatgcagaaaagagaaggcattgaaagactaaaatgagcacaaaaataaaatatttattatctgatacaggaggtttcaataatgagtaattcaagggttgattttttatatttaaacgaagaggaaatggtgaagctcggggttacggatatgaagggctgtgtggagagtatggaagagatgttccggcttttgagcagaggggattatgctatgggaggttctaatggaaattctcatgggtgcatggtttcttttccggatatatcaccttttccgaatatgccggtgaatgggccggaccgcagatttatggcgatgcccgcctacctgggcggagaatatgacatggctgggatgaagtggtatggttccaatgtggaaaacaaagacaaaggacttccgagatccattctgatgcttatgttgaatgacaaagagacaggagctccaagatccttaatgtctgcaaacttactgagtgcttaccgtacaggggcagtgccgggagtcggtgcaaagcatttggcgagaagggattccaaagtgcttgggatctatggacccggtgtcatgaacaaaacggctctggaagcgtttgtctgcacttgtctggaacttgataccattaagatcaaaggcagaagccggggttctattgagagcttcattgaatatgtgaaagtgaaatttcctcagtttaagacaattgagttgacagatacattggaagatctggtccgggattcggacgttatcagcatggctacctcatgcccggaaggatcagaaaattaccctatggtcaaagaggaatggatcaagccgggagcatttttcagtcttcctgcatgtgcaaactttgaagacgattttctcttgaacagggcaaagacagtggtagacaactttgggttatatgaggcgtggaccgaagaatatcctcatccttcttttgagaccgtaccaattataggaacaaaatttgtagatatgtatcacgatggaatcatgccgaggaagaaaatcgaagacatcggagatatcatcaacggaaaagtacccggacggaaaaacgatgacgagatcattctgttctctatcggaggaatgccggtggaagatgtggcatggggaacagaattgtatcgaaaagcactggatcagggaattgggacgaaattgaacttgtgggattccccaagaatggcgtagttttttatcactctttccgtcgcgcttttgaaatgtgctcctccaatagtgataaaaaactatcgcaggatggcaccttttggttgaaaaatactgaatgatagttgtggaaagagaaggcatttttcgctgcggataaattaagaaaagatatggcaggagggttttggctatgagaattgaagagcatccgattttgggcaggacggagaaagggaaggaggtttctttcttttatgatggcaaacctgtgacgggttttgagggtgagccaattgctgcggctttgaaagctgccggggtgatggtacaccggcatacgaaaaaatacggaaagcccaggggtattttttgtgccatcgggcgctgcacggactgtgtcatggtggtggacggcaggcccaatgtgagaacttgtgtgacacctttgaaagaagggatgagggttcagactcagtatggaatcagcgcagaaaaaactaagatgaagggatgataacgatatgaaacggtatgatttgatcgtcgtaggagcagggccgtccggcctgtctgcggccatagaagcggcaaaaaaagggatgaatgtcattgtctttgacgaaaatgcaaaaccgggcggacagctgtttaagcagatacataaatttttcggttccaaagaacacaaagcaaagatccgcggatttaagattggagaagatctgttaaaagaggcagaggatgcgggagtgcaggtcgtattgaatgccactgtcatagggctttatctggacaaagaaatcactgtgcggatcggagatgagatccggcattataagggagatgccattattgtggcaaccggggcttcagagaatatggttacctttgacgggtggacgctgccgggagtgatcggagcgggagccgcccagacgatgatgaacctgcatggtgtacagccggggaaaaaggttctgatgcttggaagcggaaacgtaggactggtagtaagttatcagctgatgcaggccggatgtgaggttgcagctttggtagacgcggcgccaagaatcggcggctatggagtccatgcggccaagctggcaagatgcggcgtaccgttttatttatcccacacgattgtgaaagcggaaggagaagaccgggtcaccggagtgaccattgcaaaggtggatcaaaactggcagaccgtgcccggatcagagaaatatttcgatgcagatactatctgccttgccgtgggactgtctccaatgtcccagcttttaaaaatggccggatgtgaaatggaagataacccaaagaaaggcggacaggtgccgctctgtgataaatacggagagacttccgtcaaaggaatttttgtggcgggagatgtgtcaggaattgaggaagccagttctgccatgatcgaaggaaggatggcaggtaccgccgctgcctgtgaacttggatttatgaatgagaaagaacgggatgagaagcttgccgcactggaagaagccctggaaagtctgaggcagggaatgttcgggcctgaaaataaagggaagcttttaaagaagacagatgagggctgtgatatttctatgaacctgcttgaaaatggttatttaggcgaagaagaagtaaaacagtacccgggggttacgaaaaccataggaatccatccggtgatggagtgtacccagaacatcccgtgtaatccgtgtcaggatgcgtgccctaagaattgtatcaagatcggagaaaatatcacttccctgccggcagtagatccggacgctcagtgcattggatgcggcatgtgtgtggctgcttgttccggacaggcgattttcctcgtgaatgagcagtttgagaaagattatgcaagcgtgactcttccgtatgaattccttccgctgccggaaaaaggggcagagggaaaagcccttgaccggagcggaaacgaggtatgccgggcagaagtggtagaaataaagacatccaaagcatttgatcacaccaatcttctgaccatcaaggtgcctgtggacatggcaatgaaggcaaggtttttccgggcctcttaaagcctgagtataaaagatggaggaaagaactgtgaatacgataaatgacagatcaaaaatattaaaggaatttgttccggccaacgatgatgatatgatcatctgccggtgtgaggaaattacgaaaggagaaatccggagagccgtccacgacgggatgttcaccctcacagaaatccggagatacttaagaaccggcatgggactctgtcagggacagacctgttctaaattggtcaggggaatcgtggcaagggaactgggagtttctccggcagaactggaaccggctacgtccagggcgccgatgcgtcctacggaaatgagagtgcttggaaaggaggtacggtaatatgggaaatcgttgtgcagatgtgatcgtgatcggaggaggaatcatcggaaatgcagcggcttattatctcgcaaaaagaggctgttccgttatcgtactggaaaagagcgatcacctgggagacggagggtccagcagaaacggaggaggcgtccgccagtccggccgagacaaacgggaacttccccttgccatgtatggaataaagaacctctggccgaccctttcggaggagctggaaacagatgtggaatactgtcaggatggaaacctgcggcttggcaagacagaagaacacatgaaaattttaagcggactggctgaaaatgcccaatcatgcggcctggatgtgcggatgatttcaggtgaggaagtccgggatatctgtccatatctgtccgatgaagtcataggagccagctggtgtcccaccgacggtcatgcaaacccgatgctggcaacgcttggattttataagaaagccagagaacttggggtccggttcattactggggaagaagtgactgcgatccggaagatcaggggaaaagcaagacaggtcatcacgaaagaaaacgtgtatgaaggagagaatatcatactggcagcggggcttaaaagcagagagatcgcggatacagtaggcgtggatatccctatgcagcctgcactgctggaatgtctggtgacagaggcagaaccggaaatgttcggacaaatgctggggacggcggaagcggatttttacggacaccagacaaaacacggctcttttgtcttcggcggttcctcaaactttgaaggctttaataaggacaacggtactccggttaattcaagcatcacggcatcctgcatttgccggggcatcatgaaatacttcccatccctttcggatgcaaagatcgttcgcacctgggccggatggatggacctgtgtgccgacaaagttcctgtcatcagcaaaatggaggaagtacccggtctgatcctggcctgcggattttccggccatggctttgggattgccccggctgtgggcgaacagctctctgagatggtggtggacggcagtacagcactggacttaacagccttaagatatgaccgtttccaggcaaaaatctaattacaaaataaaatatacagggattctgtacaatacaacgatgaagtattatagtagaagcaaatagagagcagggaagagatatggagccaatacacccaaaaaaacttatcgtgcccaaacagccgtcattggtcatgacaacatcccattactataaggctgtgatgatggcttacggaatttcacatttttatgcatttgaagtcgaagaggacgtccacgacatcctgtccattgtaccggacggatgtgtggactttctgttttattgcagcaaaaattacccttatgccagcatcataggcaccaggctgaaggcttccccgatgatcggaaagccgggagattactttttcggcatccggttcatgccgggaaaggtgatactgcccgacacggtgaatccgaatgaattagtcgaaggggaagcagcgctgatggaatttatgaaggaagaagaggtatttgataagatcattcaaagccgtgacttccgggcacagatacaggcttttttaaatttttatgtgaactgtaatcaggaaaagctggagcatttagaggacagaaatcttggaaattacctgatagacgagatcaccaggcgggccggaaatgtaaagatagaagaactgggtgaattgacgggatactctgtccgctatgtaaataaagtgtttaaagagaatatgggaatttcaccgaaaacgtattgtaagatcgcccggtttcagacgattttaaacagcctgaaatgggaagaggatgaaaaggacctgctggctattgccatgaatgccggatattatgaccagtcccatatgatgaaggattttcggaaatatacgaatatgacaccggtacggtatataaaaagcctggaagaagcggaatataagaatagactgattattttagaatgaagcatatgcaggaaagtactatgaaattgacaagaataaactactcatcaggagcaccgttggaagaggaagcaggatacagcagagtcgtcaaggcaggaccatttgtttatgtgggagacgcctatgcgcaggccaaatatgtgctggataaacaggtaaagctgttaaaagaggcaggggcaaagcctgagaaagtggtgaaagtgaatatttaaaaagagctgatgagtgaaaacatcggctcttattttaaataggcatatttattgttttctaaaacataattttccgtctttcgggtcttccacgattgcaagagactctaaatgtacacctttatcgcggatgatctgtccgccgtcctggaaacctttctcgatcacgataccgcatccaatcagattagcgccggagccgttgacaagatcgatcaatccgtttaatgcctggccattggcaaggaagtcgtcaatgatcagaatattgtcatccggggacagaaacttcttttctacgaaaatatcaaattccagtccttttgtataagaaattaccttagaggtcagcaggtctccgtccagatttttggacatggatttctttgcaaatacaaccgggatattgtcaaaatactgtgctgcaatcgtcgcgattccaatccctgaggcttcaatggtcaagattctggtgatgttttccggaaacagtcttctgaattcttttcctatttcctgaagcagcccaatgtccatctggtggtttaagaaactgtcaactttaaggattcccccatcctttaatactccatcctttaaaatgcgttcctctaataatttcataaaattctccatttcattcgacttttttatcattctagcaccaaaagctgtcaaaatcaatgagatcagggaagaattgagttgtaaaaacaccatgcctaccttataatatataagaatataggttattttataaagttatataggaatataggaggaacgcccgtgaaccacgagaaatttcttgtccttgatttcgggggacaatataatcagttaatcgcaaggagagtcagagaatgcagcgtttactgcgaaatcaaaccttacactgcctcacttgaagaaataaaaaaatacaatccaaaaggaatcattttcactggaggaccgaacagcgtttacggagaagattccgcgacatacgaaaaagcaatttttgaactgggaatcccgattctgggtatctgctatggttcccagctgatggcccatgtcctcggcggcaaggtggagactgcacctgtcagcgagtacggccgcacagaagtggagctggacaattcatctaagctctttgacggtgtgggtgataaaacagtctgctggatgagccataccgactacatcgccgaagcaccggaaggcttcaagatcacggcgacaaccccggtatgcccggtggcagccatggaaaatgcagacaagaagctttacgcaacccagttccatccagaagttatgcatacagaacagggaaaagaaatgatctataatttcttatacaaagtatgtggctgcaagggcgactggaatatggactcttttgtggatgacatgatcaaatccattcgtgaaaaagttggagacggaaaagtgctctgtgcattgtccggaggtgtggactcctctgtggcagccgttatgctggcgaaagcagtcggaaaacagctgacctgtgtctttgtagatcatggactgctccgcaaaaatgaaggtgatgaagtagaagcagtcttcggaccggaaggaccgtatgacttaaactttatccgagtgaacgttcaggacagattttatgagaaattagcgggagtggaagaaccggaacagaaaagaaagatcatcggtgaagaattcatccgtgtatttgaagaagaagcaaagaagatcggaactgtggacttccttgttcagggaaccatttacccggatgtggttgagagcggtgtcggtaaatctgccaccatcaaatcccatcataatgtgggaggacttcctgactatgtagatttcaaggaaatcattgagcctctccgcgacttgttcaaagatgaagtaagacaggccggaagagaacttggtattccggaatatcttgtcatgagacagccattcccgggaccgggacttggaatccgtatcatcggggaagtgacagcggaaaaggttaagatcgtgcaggatgccgatgcaatttacagagaagaaattgcaaaagctggagtggataaaggactgggacagtactttgcagcattgacaaacatgaggtcagtgggagttatgggggatggaagaacctatgactatgctattgcgctgagagctgttaatacatcagactttatgactgcagatgcggcacagatcccttgggaagtacttggaaaagtgactaccaggatcgtgaatgaagtggaacatgtcaatcgagtgatgtatgactgtacggggaaaccaccggctacgattgagtttgaataaattgagaggtcgtaaaaatccagtgtttatgcgggtttgcggcacttcaaaaggtcttttgataacaatttgataacagttatattagagccattattctcattatccagtggtttgtgggtaagagaatgataaaaaacggcttttagatataacaatccatattataaactaagcccttagctgtgggtatgaaactcatagctaagggctttttgtcgttattttttggaggtggttttcttttttttcggtgcaggaagttcatcgtacatagcaagaaacaggttgcagagaaattctctgttgtcaacatcatcgactaagagcatttcttttgctccctcatagggcaattcataagtaactgtaggcataaaggagattgcggatggaacaggctttacaagcaagcgatcatcataaatgccgcccacaatcttttcacggaaatagaggatatattcgcccatcattgcacgataggcaattctgatattgtcaatattagttgacacatttttctcaagcatatcactgactatgcggccagttccaaatcctcataatactgcctgcgttttatcataggtggaagcccgccattggcagagcatatcctccggttattccagtagctgaggaagtatctccaaatgagtacctttaattcctctacagtcatctgctttgtttcatagcggtcgtagagaagttctgtcttcattctggcccacatgctctcgcaacgggcattatcatggcagcgtcctccggcactgttcatgctttgatggatgtgatacttccgaatggcctgacggtagacctcactggtgtactgtgttccacggtcactgtggatgatagcgccttccagtgcaggataagcagtcagggcgttttccagtgtatggacacacagatctgctttcatgtttgtttccattgccagaccaaggacgctaagatcaaagcagtcgaaaatcacagatacatacagtttcccattggacgccgggatttccgtgatatctgtaatacatttttctaatggggcatctgaatggaaatcccgtttcagcagatcatctgatttcatagcctcccggtctgcctttgtgatcccgttcggtcttcgcttggggcgatggctcaggccaatttggtccatgacccggtatacggtccgctcactgggaatcgacactccctccggccgcttcaggcacagtgcctgatacatccgaatccgtccgtaagtatcgttacattcatcctcgctggcgatttctttcatggcatccgccaggtcttggtacttccagggacgatctttggtttcaagatatttatagaagccttgccggctgataccaagcattcggcaataaaatgaaattttcccggtaatcctgccgtcctctgttttcaaagccaaaaagatcattctctggtttttactgacttccgacggctggcggcgaaaaaagcgctggcctcctccaaaaattcgttttcttcctttaggcgacggatttctttatcctgctccttaaccctcttacgcagcatggtaatctcttctgacaggctcattgcgctggcaggggtatgggaaccttccccaatatccaacttgccagctcttacggctttcagccatgtatggatggttccttcagggattcccagttctttagccgctttggcgcctccgatttctttggcaagttttactgcctgtactttgtattcatggtcatatttacgtgccactttgaatacctccttattctcttggttttattatgaaatccttgagaataaactgtcaactttttttataccacaccaccctaaatatcagttgccagagccacaaggatttatgacggcaaaatcatataaaacaaagatggtagagccgcttgtaaagagactgaaatcgctcttgaaaacggtgcttgcccgctgctttgaggggtgggataactaccataggctgaataccactaacagaaatttgtatcaaagcaatgagcgattaaaaagtcacaataagcagttgaatgctgacaataatcgtttgcgggaggaaattaaagactacaaactgctgcgaaaagtattcggtagcagacaaattgacagcctgttagagcaggcgaggcagtctaaacagcgtggcacacgctttagaaataaagaaaacgaaaggtaggaacaaacaatggtaaagacaatttttgaagaaatgggtggcacttatgtacggcaaggggattatcttatcccctgcctcaccttacccgccgaaaaagaacagtcgttaggcttattcggacagcggcatttgcggtacttaaaggaatatcacaggcttacctacaccaatctgcttacaagcggcaaactgaacacttaccttgccgacattgacaggcaggcacaggaacgctttgaaacgcttacagagctgatgaaacaggcgcagggagtcacagagcagctaaaagcggaaaaccagattgattgggtagggagaatgaacaatattcggcatcgggcgatggagattgttaatcatgaggttatttacgcataatgtaaaaacggcggaggggagaaatccttgcctccgttttttatttaccaaattgaaaaatcgctaatctcgtcctcggaaaaaccaatccacttcaaactcatcttcttaataagtttgtcgagaagaagaatataatactttgcctttgaatcagacttaaaatcataataataagcatatccgtgcgcaacagaacgccgcaattctttgatattttcacttatcacatccacagactcgttagtattggacagcaattcaggaaaaagattaaatgaatacttcaattcttcctttagtggacaattcttatctttcgcttttttgtgttccaatttatcaaacaggtattcaaacgccattgtttgttcaatataacgctgtggggaaaacatagagtcgagtgtacctaaatgacctaacggtacgctctttgttatcttattgccgaaatcaaacgctatgttgtttagtattttaggtatgtacttcataacgtcaaactcataaaagaaaccgtcgttccctgaaactgccttctcggacacaagcgggcagtaaaaccagccggccttgagtccttggctatataaggtaatacgtttgaaaggcacttctgagtgggatgtcataaacattgcaagacgattcaaaaccacggagatatccgagcactcctgaatggttttgttatgaagcgggatctttatttcgccttttttatcgtaatcttctaggatccctaatttattttcatatccaataaggaaagataacgcatactgtctatcttgcattgaaaagggaatcttatatatttctttaggttccacagagaaattgacgcctttcctgaccatatctatgagattgtactgatacctaaacacatcatcaaggaacggtgattgcacaccgatggtatcgtattcatcatccctgtcaaacatattgatgatatagcaccgcagataacaagtgctacccatggaattttcaactaaaaaagtagcagttcttgcaatactgccgctgtcaaaacattggccacgaaggatataattatctttaaaattatattctttgcaataatctgcaaggattggctcatccgaaaataattccatgcggtaattgtcaattacaaacggaatcttacattcattgaagaatacaaatcctttcaccatactttcacctcatattctatccccatacggcaaagaccttatataattttccataaaatcatagtcaggtttatcatcttttgcaggcaactttattatggttgagcgcatgctttcaagcacccattttcgcccatacgaataacggtacttttcctgacgaagcacagcgcatataaacaaggcgatatatttattgaaggcaatgccgttttcctctttgaaatacagtacatttacatcatcagttgcccagaatgtttttggctgataaaaagcctctccaacagatccattgtagctcagagaaatagtattaccgtcgtgaatagcagcttgtccaatataattagagacaccgttgtttgaatcaatcgccccgatatatggagtcgctccatcggtttgttcgtcagaagtgagtcgttttcccttttttacttcaaataaatctcctacacaaaattccttccacgatacaacatcaagtgtatgtgattcgtaccttccctggttggccgtggttaacggcttgtgattcaacgactttatatactgctccataaaaccccaatctggatagttatctatagtagctggcaatttgattatggtattggatattaaatccattttaaatgccctgccataactgtacttatatttttcttgttttaatattgaaatgatgaatagtgccgtatatatattgatccaatcagcacgacaaataaccatgtggtctccacaaataaatttatcactttgataggaacaggttgctgttgtatcaccaatagcaatagcattcccatcttcaactcctgtaagtccaacatttaaaacataacaatcacatccattattcatttctgtacgagaaatgaaacgaattgtattttttgaaggaatactgtaaaaatcacaatcgcctttcacatgtgctttagccttgtacatttggcaaaacaaatcccctagtcgaaattctttccagtgttctacattaagcttcataaatatgcccttcctttacaaggtaagcaagataatcattgattgtctgctgaaaatcctgttctgtaagcttcgtgtaatccgttttcatataagcttcacaaagccactcatcatcgccgttaactttatgggttgccgaaagaccgtctacagaacgcctgttacgatacagttcaatccattcacgctcaatttctacccatttactcttgcctgtaccagtatcaatttgctcgacacgtcccaaatttttcttctttttaaacccatcatctttgcaatacccaaagaaagtatcaggattggaaacatcattatgtttcgtgccgattttgaacaccatacaacaggcagaagcacttgcgccgggataaaaaatctcatttggcaaagtaaatacagcatcaagtgtgttttcctccaatatttcacgcttcaaacgggcaatttctccgctagttccgatagcacaggcaacaggaagtaataccgccagtttagcctgatgattgatggaattaagcgtgtcggcaatatatttaacaaagtataatcctttagaagggtcttcttttttattattaccccaagtggcaacatattttttgggcagatgaattcgctgaccgttatatggtggattcattaggattacatttggatttgcttcttttatccaatctgctaaatcaaagcaactgccctgtcgaatatttgaatttccatcggaatgaataagcatattagttgtagcaagtccatagatgttttcatcaaattcaataccaaatatttgatgcttttttactttttcctgttctgcagcagtagcacaatcatccaatgcttgtgtcattgctcgaaccaaaaatgatccgctgccacaacaaggatcaagtactacagaatgcttgttcacaccagtaatttttgccataaaatcagtaatatgatccggtgtaaaagcttggtttttatccgattttccgacatatttattgaaggtaacaaagaacaggttaagcaaatcctgtccagaggtgctcttatcattgataaaaggtagaatgttattttcaataaaattcaaaatttctctaaaagcggcaatattcaattgacgaatgtattggtcacccaagacattacggtttaataaagcaagtttctccgccttattaatatccgaattcagcaattcttcaagaacttcttttattcttgtccttatttgagcagctgttaaagaaggagttgaatagtctaaaccatttttcagagcaagaaggcatgtaccaacaaactgacttctcaatttttcaggaatactgtggcgatgcagcaattcattaagtttatatgtattctgcatcactttttctttatcattgatttttgaagtgtaaaaatcaacatattcgtccatagatcgaagaactgtttcttttggcataagatcactgtcagaaacaacgcctcgccacacttttacattgtcgtttacagtattcgctaaaatagcaactgtcttattacctgtcaacgctttttcatattctacataagcagataattgctcctcatctgcctttgtaaagttctgtttggtttcaatgagcacggtaatattatccttaacaaaacgaatatccaatttttcaaatgcacgacctgcactatttcgaataggaacaaatgtcaaagatgatgcggaaaaagctttcggatagctatattcgtcattctcaatattgctggtaagataagctctgccaacagttgaaatcatatctgttctaatcattttctatttctcctaatcatatccactcgccatcagcggcagaccatttttcagtaaactttttgcttttgaccgccgctgtaaacggttctgtcaaaaacgcctcaattatttttagcactgtattgaaatcgtcagtttgtgtatcaatcttccgacagaatgctttccattttttctgcatggcagcatcagcggcaaagctcataacctgctcaaattgttcgagcgtgaagctgtgttcacggtttgaaaaggtctttctgagtgattcagtaagcactccgccatcaaaatcaaacttgttggagatataataaatatcgtagtaatccttcattcggctggaaaactccatcaggctcaaaatggcatcgagtttttccgcaacggtggtttcaaccgagtaggtatttaccgttggtgattcaaactctggaagctgcgttggtatctggcgcttttcctgtttcggaacaatgacatctcctacgccaaagtcaatgctgaatggcgttcttgtgtttttgatacgggcaacgatagaggcaccaattcccgaatactttttagcgatggcaataggcgcaacatccttgatctcaaaggttacaaaatcattgccggtaggaactgttatgatttcttccagaagggactttaattgttccggcgtgtttggtacttgccgaagcaaaaagtccacatccaccgttacccggctatcaaagtcagtcagagaataaaggaacaagccaccttttaacacaaggttttctgcataccttgatttctccaaacggcggagaaattcttcctgacaaaaaagctgcaagcagagctgatagcttctgccgctttcagcagctttatttttcagtcgtgcaagcacggaagcagcaatatcagccattgagcagcacctccatcacatccatcaattttttataaacccgcattttctttgcataacttgaaagattgctcaggtttttctttttatcggcagcataggcattgagcgccttattaaacatttcgttgtccagctttgtgcggtatttgaaacagtcgcaaatggtgcgttccctatcataaacagcaagctgcactccattaaaatccccgcttgtttttccgatttcaaacaaggtaggctgtacaaaatacacctttgtcgccagagaatcgatatgcagctttgtccgtgaaaaggtacggggaacggcaattgaccattgccggggcgaaaaatcactgtagccataataaaacagcgccgattccacgcatacaatgctttcaggaaggagagtggcaagcacttgttcttcctttatatcttcctgctcggcaagctgataatagccgtgcctgacacgctcgagataaccctctttgcacagattggctacatcatagttggtaagtccttcggcaacaaaatcagcggtttttgcaataccgtcattgttatttattatgttttttatggtttcctttttgtccatttgttcaccaactttcaagccacagcttattgatactgtgttcggaaaatattataccatagaagcgtcccaatatcaacaatttttaaaacacaaatataagatattgtgaaactaaaatttgaaattttattgcaatataacttgaaatctgctacaatattttcggacgagatggtattgctccatgctaagagaggcaagtgttatcaacgccgataacaaaatgataacattagcccatataggcaggataatatggatatatcaaatagtcaaaagggctacatacacgacaaataataatcactaaacaaaaatatttaggatttgtcgaaagaaaatgaaaaacgtgtgaaagaaagagaacgaccaaaatccgtaaacaaacagaaaaaacacgattggttggatcggtaataaaaaatattcatgcataaaataatcccaggcaacagaagaaaatttgttgtctgggattatttgtcatgtgtcagaccgttgaaaatagtgttgaaatctgtatggaaaatttccgcaagagcaatcagttcgctgatacggatattgtaagttcaggcctcaatctgggaataaacacttctagatgtaggaagattacgcagctgcaattgtgctacgacctgctcctgagtaagattggcagcatttctcagttttcgaagattatctccgatggaaatatcattaatttgctttaatttttgagccataaagatttcacctctttccattcatacgaattccttgccattgattttagtataaaattctcatacaattgcaatgtatagtgaaccatagtcaagtaagtagacacatatattagaaaaatctttctggaaagagggactatgcctgattccagaagagttcttctttttcgttaggtgttaacattccaagagagctatgtggccttcttgagttgtagtatccttcaatatatttaaacacagagagttgtaattcctgtaaagagtgataagttctccggttggtttcttcttttttgagatatttgaagaaacattcgcagcaagcattgtcgaaagggtatcctttctttgagaatgattgcacgacattaagagaatccaatagctgcttaaatgagaaagcagtatattgagatccttgatcagaatgaaacataagtccggaaggacagtttcttttagaataagcttttttgaacgcattcataacaagtttaacatcaggttttccagagatgttccaggaaatgactttgcgcggaagtaaatccattacaatacagaggtaataccatttaccagaaaccttgatataagtaaaatcacttgcccaaacaatgtttggtgccttttgattgaagtcctgatgaaggtgatcgggacagtcaccattgtctttgtggcggtaattacgataaggcttatcggtggacatgcgtggtaattgaagagttctcatcaggcggtacactcgtccgacactgatgtgaatgccataatcgcgctgaagaacatatgtgattttgtaagcaccaagacgcttattgtaatcagcataaatctgaagaataagtttggctattttctgattttccttggtgcgattagcaggctctgaattgtaatgcttataataagtgcttctgttgacacctaagactttgcagagaatcttgatatcatgctggaagcgaagcttatgaacggcgtctaatcgttgttcgaatgtggcgtgaagatggcaatcgctttttttagtatcataagttcttcaagttgagcgttacgtttttgaagttctttgacttgttttgcggtaagaatttcgccatcatccgtttcaacggttgaatattgtttgatccaacggccaagagctgtaatagagactccgtattctttacaaagagcagcttgggattttccgccggattgatacaggttaacgagagtacgtttgaaatcttcgtcatacctatttccagttttaccagtggacatgagtaaatacctcctttttggtgtctactttattgtaatgtattgttactttccgtgtccacttatttaatatagatccactgtttatatagattataatttagacttaaaaacacaagaaaattgttgaaattattcacgaattttgagagaaaaaaatagaaagacaaaaaaatatataaaaagtaaaaaaaaacttgaaaaaataatacaataatgctaaaatctaaaataacacaaagtactttgtaaaacaaaatagttttgagacaattgtatggcgaatgatgaatgcaattaaaggatttagagaaactgaatcctttaattgcatttttttgtcagaaatatctcgagcggataagagaaaggagcttaaaatggcaatatttaatacgattataaatatgggttcaactgttataatgccaattatattttttatcgtaggcattattttccgagtaaaaccaggaaaagcgtttaaagcaggtatgacggtaggaatcggatttaccggtattaatatggtagtcaatcttctgctaaacagtctgggaccggcaactcaggacatggtggaaagatttgggctgaatcttacggtaattgatgcaggatgggcgacaggttctgccataggctgggcatctccgctgattccgtttattgtggtaggggcaatcgcattaaatataattcttttagcgataaataaaacaaaaatcatcaatattgatatattcaattattggctgatctctttggtaggaacattggtttatcatgtcacaggcagtattccgttgggagttgcaggcgccctgcttctgtatttgattgcatttattattggagaccttacagcaaaacctattcaggaaatgtacaagatcaaaggtgtggcgtttgtacacgcaacatgcggcgtatatgttcccctcggtatcgcagttgactgggttatcggacatataccgggtctgaagaaaatcgacatgaatcctgaaaagattacgaagactctgggaattttcggagagcctgtaactctggcaacaatccttggtgtaggtcttggactgttggcaggatggccgctggatgaagtgcttccgctggcggttaatgtggcggcagttatgattcttctcccgaagatggtagatgtaacagtcgagggagtaatggttatcagggatgcagcagaagagtacatgaagaaattgttcccgaacagagagttctattttggtatggataccgcacttctgatcggagagccttgtataatcgcaacatcattactgctgatcccggcatcattgatccttgccatgatacttcctggaaacaagatgcttccgtttacggatctggcgtccattgtattcctaatttctatggtggctccgttttgcaagaggaatatgttccgtattttcgttacaggtctgttgattataacaatccagctttatgcaggaacaagtctggcaccaaacttcacagcagctgccgaagaggcaaacgtagaagtgaattcagaaggcgaccaggaaatcggtagtttagtggcaccttataatacacctgtaggctgggcaattgttgagttgggaaagattattggagggaaatagctgtagctgatatatttaggagtgcttttcgttaagaaaggaagatgattaatatgaaaattgtaggtattggagatttattaattccagagaactttatcaaaagtggatttttggggttggaaaaaatggggcatcggatagagactgttcagtggaaactggaaaattatgaagaacttcagaatatcaatctgctggttgagactcatgggagtgaggcgtacgaaccgtctaatgatgttttgcaggctgtacaggatgccgatgtaattataacacaattctgtccgataacaaaaagagtgattgattcctgtaagaacctgaaaatgattggagttcttaggggaggatatgaaaatattaatgttaaatatgcaacagagaaagaaatcatcgtatgtaatacaccgggaaggaatgcggatgcggtagctgattttgcagttgggatgatcctaagcgaatgtaggaacattgcaaagagccatcgaaacctgaaagagggaaaatgggtaagggattacagtaacgctgcgactgtgccggaccttccgggaaataaagcgggtattatcggattgggagcgattgggcgcaaagtagctcagaggctgcgtggatttgatatggaaattatggcatacgatccatatgttaaggaagtaccggactatgtagagttggtttcgctggagaaattgatgagagagtgccttattgtaactttgcacacaaggctgagtgctagcacggagcatatgataaatgcagaagtgcttcgaatgatgcgcccggatgcatatctgattaacacggcacgttctggactggtagatgaaaaggcgttatatgaagtgttaaaggcaggaaagattgcaggagccgcgttagatgtgtttgatgtggagcctccgttagcagactatcctttgattacacttcccaatgtgacagtaacacctcatcttgcaggaggtacagtagatgcgtttacgcgatcgccgaaactgcttgcaaaggaaatggaaactctgattacggaaaaagactcaagatttgtggttaataaggaaattttttcaaaagtaatagaacaaatataatttgctgacaataggagaacgacagatggaactgggattaaaaggaaaaaatgtactgattaccggaagcaccaacggtcttggaaaagcaattgcacagcttatggcacaggaaggtgcaaatgtggttattaatgggagaaacaaggaaaaagcaaataaactggcggaagatatcagaaacacatataagactgaaatagctgttgtccctgcagatttgtcagaggaaaatgcggcagaggatttatttaggaaaagtgtaaaagctctggggaaaatagatgtattagtcaataacgcaggtatatggccgacggcctatgtgcgtgatatggaaaagaaagagtttgagcgtaccatatacatggatttggaagtgccttatatcctgagcaggatgatggttaatcatctgatctcacgggaagaaaagggcaaaattatcaatgtagtctcacaggcggcattccatggttcaactacgggacatgcacattatgcggcagcaaagagcggattggtgacgtttatgatttctctcgcaagagaagttgccaaatacggaataacagtgaatgcagttgctccgggaattatgaaaacagaaatgatccgggagtcattggagaagaattcagattattataacagccggattccgctggggcgtgctgcattgcctgaagaagtcgcatattcagttgtatttctggcctccaataaagcggattatctgacaggaataacaattgacgcaacaggcggaatgctgatgcgatagcagttgttgagatggattgaaaggagaaagttacaatggcattagtttcaataaaagatatgttaaataaagcaaggaaagagaaatattgtgtgggggcgtttgatgccagtacattggagatggcgcagaaaattatagaggcagcagaagaaaaaaagtctcctgtgattattatgggattaacaccagatctgcagggagatatgcttgattattggattacttgtttaagaagaatggccgaaagagcaagcgttcctgtatgccttcatttggaccatgcaacagacatggcttttctgaaaaaatgtgtggactttggatttacatcagttatgtatgatgcgtctgtatatccattggaggaaaatatccgtctgacgaaagaggctgttgaatatgcccatgcacatggggtaacggtggaagcagagttgggacatgtgggagacggtattgtatccggagaattaaaggcggatgaggattatgataatccggatgactacctgacaaatcctgatgagatgaaacaatttattgacgagaccggtgtagactgtcttgctgtagctgtgggaacatcacatggggtttatgtacatacgccgaaactccactttgaccgtttggatgaattaaacaggatttcaagtataccgatggtaatgcatggagggtcaggaactccggatgaccagataaaagaagcaatccagaggggaatctgcaagctgaacatttattcggaaatgttgagtgcatattacggagaattaaagaagaaactggaagagtcaggaacacttgcaatttgggtgagcaaggcgaacgagaaatctcttgcagctctcaaacaagtcgtactggaaaagattgacttagtaggatcagccaataaggcgtgaaggcaatagcagatggaggtataagtatggcagaatatttaatagggattgatgccggatgtacgtctagtaaggcagtaattttcgatacagatggcaggattatagcatcagcagcgactccgagtatgaggtttaagaaacgcagggctgattttgaagagtttgacgttaatgaactatggaatcttgtttctggaacaattaaagagtcaatacagaaagcaaagattgatccgtcattaatcagaggaatcggggtgacttcgttcggaaatggtgtagtatttttggacaaagacggaaattctattgctccgggatgtttttcacaggattacagagcaaatgaaattcttgaaaagtacaaaaaagaaggaacttatgataaaattaataatattattaaaggtacactctgggctggtcagccggcaccgattcttcgctggtataaagaaaatgacagagagacctacgataagatcggtggattttttacattcaaagattaccttatgtatcgtttgacgggcgtgtttgcgacggatctggattgtattgggggatcagcccttcttgatatggagacaatggaatattccagggaacttatggaactctttgggattcctgaattgtacgacgtccttcctaagttagcagagccgacagagattatcggttgcgtgacagaggaagccgcaaagctgacagggcttaaagtggggacgcctgttgtagcgggaatgatggatattctggcttgtcttgtaggcgctggagctacaggagggggtgtatacacagccgtagcgggcagttggtgtattaatgagacacactcggagcggattattcccggtgcttcggcgaatatgccgtatctgcacaaaggagaatatcttaattgctcttatacaggagcttcgggatcgaattatgaatggtttatccatacactgggggataaagcgaaggttgaagcagagaaaagggacgtatctatatttgatgtactaaatgaactgatatcagaagtccgccctgaagacgcaaaagttatcttcagtccgttcgttgcacagccaagcatccatccgaacgcaaaggcaaactttattgggatcgatcagaatacaagttatgccgagatctgctattcagtagcagagggtgttgcgtatatccataaatatcatgtggattttctgaagaatgcaggacttccgctggacacaatacgtctgacgggagggatagcaaggagtaaagtgtggaaacagatttttgcagatgttttacaggtgccgattgtcggagtagactgtgaggaaaccggggcgttgggctcggcaatcgttgcgggaattggtgcaggcgtgtatagtaattatgaagaggcatttaacagagcggtgaagacaaaggctccggttatgcctcggctggaaaagtatccttgttatgaaaaacgttatgcagagtggactaacataaatgaaatgatgaaagagtactggaattataaataatataggcaggagagaatacgaattggctaaacaggaaaagttatttggagattgcaaattccatattattccttctatccgggaattaaaatatcttaaaaaagcactggaaggacgagaagaatggatattattaagctgctgtcatataggtaatttgagagaaaatgttgatatatgccatagggcaggaaagaaagttattatcaatcacgagcttgtaggcggactcggggcagatagaatggcatttcaattgttaaaaaatatgtatcacattgatggagtcatgggaacaggaaatacaaagataggtctgatatcaagagaaaagatgaagtcaatccgccgtattgtgctcagcgattcgttatcggtagaacaggtgttacggagtatgggagatatggattatgacgggatagaattaaggccggcgtattatgcagtacaatattataataaatttcgtgcaatatgtaattgttcatttgtagttggtgggtttgtaaattcagaagaaatcctggaaaaagtgtatcaggcagggttttcaggaactatgacaagttgtgtggaattatggaaccacccacttggaggaaaagaaatcctatgacgtcacagggcgggggattttgttccaccctgtgatgttctaaaacggtagaactgaaataaataaagaaacagtatcagaagagagacgccacggactggtggtcaacgatcttgacatctgtttctatagttgagggcgggcatcgctccatcatctaatttgataattttgcgacaatctcaagagagatgttttcgattgttatgaggtgtttatggtttgcaacgcgtctgcaacaaattactatgaaacccttgattttctcgctgttttcggttatgtaaacgagaactcgtaaaccagcggataaaatttatttagagtaaaaaagtccggaaatgttaaacaattttaatgaggtgaataaaaatagcgtggctacattttggctacaaaaatattatgaacgaaacgaatcatgcatataaaataacataaaatgcacaaaaagcgaatccataatacatattatttatgattggacaaatataaaagtggagttcgaataatgaaaaaatctggaaacccttataaacagggcattcccgggcattagaggttctatttgataacaaaatgataacactggagattttggtattatttattatcaatccgatggttatcaggtaatatgtgtgaaaccaacaaaaaaggtcttcctgaattgagagaaatcaatttggtaaggccttttttcttcggcttttattttgtatttttcgggtaattgtaccgtcactgatcatattcttccttggtaattttcctggatttaagtttttctgcctgtttctgccatgcatggaacatatcaaacatagaaaggtaggtggttcctttggatttatctaaccggaggcagagttctctgtcaatttctccgatatgaagcccataaaggtcttctaatgcaaataaggtgtgcatcagtcctacataactagtgcatttagatagttttcctttggactgcgagagcttttttcgtactgtgcaatgcgggcatcagcctgcacttcactgaatcccaactgctgacctaaatatttcagcagcattatcaacatccggcgattttgccatggcagcaacaattccagcggatattgcacagtactatggttatatgctacgagtgacacaaaaattgttgtatttgtatggattcccggaaattgacgttacagaaaaagggaaaaagtttgacacggagacactgaatatcttgactctttgtctgggagtaatgtatggagttgcaggtgccaataatgcattgaaagcacctttacaggatacgtttttgtgtaatccggatcatgagataacagcagaggagaatgcttttgatattgaagctgctgaaatcaaagagtacagtgaggaaggcgaagaataactataattaagtgctgtaaaattttaagttgaattttacagcacttttgcgtataataagtatagaaataataatgataaatcacggaggacggtctatatggcaaatattttaccagtatctgatttgagaaattataatgaagttttaaaaaattgccggacgggagaaccagtatttttgacaaagaatggaaggggacgttttgtagtgcttgatatagaagattatgagagggatcgtgcagaaaaaaaactattaatgaagctacaggaggcagaggaggcagttaaagacggagaaggatggctcagtttggatgaattaaaagcacttatgggggattagactatgctgaaattacgaattaacccattagttgcagcggatttaaaagagatttgtgattatattgccgaggataatgcagaatatgctgcaaagacgatcaaagaaatctatagtaaatttgagaatattcaactgtttcccgagatgggggcagatctttccaaaagagtcagtttccgaacaaattataagtatgcagtatgggaaaattatgtaatcttttataaagttggagaaaagtatgttgagatttaccgggtggtaaatcggtatcgagatattacaaaattatttgaatagttattatggattcaaaattcactgaaggaaaagggatgagtaattttgtagaagacttagatgaaagatattggagagaacgtaagaaaaacagaattaagaaagaaaataagacttttgtatgtaatattccttttcgagtgaaattatatggaagtataaacgagaactacataattaggaaggggaaacttacgagatttttgtacttaaagaatggttgtagagtatattttacagatgctgactttttgaccatgttacttcaaattcaaaataaggatacaatgacatcacttattgaaaatttggaaagagcatataaaaattgtgctgaaaaatattatatatggattggttagaaaaagtatgaaatagagggtatacctcagacagaagatgagcagattcttatgaacccacaggatgtagagatcttgtttaatgaattacttgctttgataaacctagttttattaaaggatcaagcgtctactccattatggccaagtagaccagattttttttaacatacaacatcaaaatacatccacaaacggcaggcttttgaggatggacactttttgatagaatgcgtgaatggcagttctcctgaagaatgcacatatgattctggaaatgatcgctctgttgcatatttcataatagagacatgtaatgcctgcccatatagggacaaatgtcaacctcgatttctaaaaacaagagtccgaaaagaagtttcatggaaatcggtcggaagagcaaagcagctacagtatatgaaaacacattcacaagtgacaaaaccccactgccatgctatatttctcttataaggaaagccaaccacaaatccaatggcatgggagagattaatgggaaaaccaggaaacaaaaaaaacattataaaacttcttcaggaaaacagaaataagcagactgcagaagaaatcgccgattgtctggggattcaaaggaatacagccagtgctatcttaaatgagcttgccagagatgaaatcgtccggaaggagaaaacacgtccggtgatgttttcttatatagaaaaagattcggtattttccgacgatccgtttgcgtcctttattggtgcggacaaaagtctgaaggagacggtggaaaagtgcaagctgtctgcgatatatctcaaacgggatatgcctattttactgtttggcccaagtggcgcgggaaaaagtctgctggccgagtacatttataaatatgcaaagtatatccacacaataccagaggatgccccgtttgtcgttttaaactgtgcagactatgcaaacaataaggaactgctgtcttctgtcttgtttggatataaaaaaggtgctttcactggggcccacacagatacgagggggctgatcgaggaagcggataatgggtatttatttttagatgaggtacaccgtctttctccggaaggacaggagaaattatttcattatatggataaaggggttgtgtcacgggtcggtgataatggacataacattgaactcaatgtcaggctgattttcgctacgacagaggggaaggaatccatgttggatacttttttaagaaggattccggtggaggtgacacttcctccgtttcacgagcggactctggaggaaagatatcagctgatcatttatctgattcatcaggagacatttgtcatggaatgcagctttttggtgagtagcaatgtgatcaaccgattgctgacctttcagggaaaagggaacatcgggagcctgcgcaatattattaagctgtcatgtacaaaggcttataatgaggcggaagataaaaaggggacagtaccgttaaagctgagacatttatcagatacacagaagtttatgacaggcatcggttcagttccttatgtaaatcaagacgttgagatttcatcggaaaaagagtcggttcagtatattttgacaacggagcagatccatgtgtatttcccggcagagaccattgtcacggcagtatatgaatatctggaaaagaagatatcaaaggttcggttccgcaaaattatttatgatgagatcaatcatatgatagacgatgtcatttatcgggaaatggacccatttatacaaaatctctataaccaggcggtcaacaatattttagtgtatcttcaggacaattacggcttaaaatacaatggggttatggagatggtgtttgtaaaaatcttatatgacctgaataatcagagtgacaaacccgatgacagtcaatacgagatcatcgtcaggaaactgcagccggtcatgtaccgctactataaaatgggattgatttttacggagatgattcaccagaccatggattatgagacaagtccctggtttgtgagattatttgttatgctgtatttttacagtatggcaaaggaggatggggattataccaatgccattattgtatcccacggacctgcgacagcgtccagcattgcaagcacggtgaacagggtgtttgagacctatatctttgaggcgtttgatatggcatacgatacaccgaaaagtgaaattgtgtcgaggataaaaaaatatttgaaaaataccaatacgtcaaaaggcctgctgatctttgtagatatggggtcgctgctgagcatatccaaggatttaaaagacgatattgaaggggatcttggcattgtcaacaatattactacggaaatggcattagaagcgggagagagaatcctgcgtcatgaagatcttcagagtattatggacaatattctgtctcaccatgtgacgaaaaagtcgtatgtgcccagcagacagaaaccgaaagccatcgttttatgctgtatcacggggcttgggactgcggtgaaaatgaagactcttctcaaagagtgcctggaaggaatcgaactggaggtagtggaggtgccgtttccggatttgcagaggaacgggagccagtgtgatgttttccggaagtataatgtacagtttgttgttactacgagtaaattggaggcggaggattataccgcgattcatttgaatgaactgatagacaaacggggagaagaggtcatttatgcaacagtaggcaaatattttgataaggaaaaggttcagaagtttattgaaaatattgtccgcagttttaccataagaaacttgatcggccagctgacgattctcaatccggacaagattttagacgatgtggaaaaagcagtgacgaggctggaaattttggagggagagaattatcctattgatttgaaaaaaatgctttatattcatatttgtgtgatggtggaacgactgatcctggaaaaaggacaattatcagagagtaatccgacacaaagtttaaagtgtcgggaaagctttataaaaaacttaaaggaaagtttttctgtcatagaagcccagtataatgtgtcgattaaccatatggaaattcatatgatttatagtttgataaaaaatatttaaaaaataaagtgctaaaagagcttgtatttatgcggttttaaaaaatacaggctttttttattgcaaaaaataaaagttggcacagattttgctgtatatatttgcagaggcgaaatgatgcgtgatatggaaattgtatgccgagtgtcaggaaaccttaaaatagacctggaaaggaggagaaaatggtcggattaattattgcaactcatggaaatacttgtgcagaactggtgaaaagtgccgagatgttttcggggccattgaaaaattgtgagacatggactttaaacccgggagacagcattgaacttggagaaaagaaactggagcaatacgtggaaagtctggatgaaggtgccggcgtcatgatcatgacagacttattcggaggaacaccgtcaaacgttgcgttaaaaatttctatgagaaaaaatgtagggattttgacaggtgtcaatcttccgatgctgattcagtttgtatcatgcagagagaacaattctctggacaatttgatcttggagtgtacagaggcaggcaaggatggaatcctgtgtcctaacaaatcaattgaagagtggaggtgtacagatggcagatattaaaatggtgaggattgactaccgtctgattcacggacaggtcgtcgcaaaatggttaaaggtaagcccggtaagaaggatcgtgcttgtggatgacgtgctgggcagcgatgaatttatgagtgatatttacaaaatggcagtgcccaagggtaccgctgtggacattgtaactgtgaataaagcaaaaagcgttctggataaaaccaacgatacggtgtttcttatttttaaagatattgacagctgctgccggacgatccggaaaggggttcaaatttcttctctcaatgtaggggcagttcccaacgaagacgggaagaatttaattacaagcggcgtggcgatttcggcaggggaactggaaaaattagaagaactgaatgcagagggagttgaaattacggttcagcccatccctgaaatttctgccatcaattttgatgcagttaaaaagaaaatgtaggaggttaaaatatgagtactgtggtaattgcggtcacgatggggatcatgtactggtggtgcagaggaatgatcttttcgtactttggttttttgtttatttcgagtccggtaaccgtcggacttgtggcaggattattgatgggtcacccaatgcagggattgatcatcggcggagggattgcccttgtgtttgcgggaattatcgcgccgggcggaaatctgccaacagatgagtgcctggcggcgacctgcgtgattcctattgcaattgggtcaggcatgagtgcaacgaccgccatcgcactggctgtgccggtcgggctgcttggctcttttgtgaccaacttaagaaaagtggtaaatacatactttgtaaagaaagcaaatgattatgcgaaggaaggaaacgcgggaggcatttggagatgtgcgacactttttccggtgctcctggcaattccgcttctgtttctcccggtgtttattatcaacatggtggggcaggatgtagttgtaaatctgatgaatgctcttccgacatttgtgactcacggtttagaagtcgcgggaggtatcctgccggccctgggatttgctctcatcatgaatatgattggaaaagaaaaactgatcccgtatgtgtttcttgggtacattgtgatctcggttggagggattaactcattgacggccggaatcattggaatctgcattgcatttatttatgtgttccagaagagagagattatggaggaggtaagcagcgatgagtaaggaagtaacgacggcggatacagcccctgcactgacaaaaaaagatttaaataaagccatgttccgctggtatatgtcggcggagatgccactgaattttgaaaatatgcaggggattgcattttgcggaagtatcgcaccgattttaaaaaagctgtatacgaaaaaagaagacctggcggaggcattaaaacgccatctgctgttatataactgtaacgtgactgctggcggactgatcctcggaacgaccattgcaatggaagaacagagggccaaaaaaccggaagtgatgccggcggaagctatcacaggtttgaagaccgggcttatgggaccggtggcggctctgggagacagttttgactggggtatcattggcacgttgtttaaaatagcagcagccacattggcggcagcggggaatccgtttgcgattgcagtgttactcgcttttgtgatgtactgtatcgtcgagttagtattttttacaaatctgacttataaaaagggcagaagttccatcaaaactattatgggttccggcctcatgcaggacgtgatttccggcgcaaatgtgcttgcgatgtttatgatgggagcgatgaccgcgtccatggtcacactcacaactccgttaaagattagcagtgttgtcattcaggaaaaactggacgggatttttccgggagtctttccgctggcggccttgttcctgatttactatttagtcagacataaaaaaatcggaaccggaaagattgtcattggcatcatcgcagtttctatattgtgtgccttaataggtattttttaaataaagctatataaataagctgaaaaaaatcaaaggagattataaagatgaaagttatgaatgtagccgttgtgggagccggaatatatggaattaatcatgtgaatgcctatacatggaatccgaatacaaatcttgtggcggtgtgtgatctgaataaagaaatcacggataaaatagccaaacagtatgaggtcaagacctacaatgatgtcaatgaaatgctggataaagaagaaatcgatgcggtgtctattgcgacccccgatgcctttcatatggagccggcgttggcggctatccgccatgggaaaccaatcctagtggaaaaacctttggctacgacttcagaggacgcgaaaaaaattattgcagaagccgaaaagtataaggtgcgtgttgcggtggattatcataagagatgggacccggcggcgatcaatgttagaaatgaactgcagaaagcggaaacaggagctcctgtccgcgggtatatgaatatggacgacatcatcgacgtcccgacggaatggtttggctgggcggacaaatcgagtccggtccatttcctcggcactcactgctatgatcagatccgctggtacatgggatgcgaagtagaagaagtatccgccgtggggacaaaaaaggtcttaaaatcaaaagggattgatacgtatgattcgatccaagccacattaaagatggaaaacggatgttactggacagtggaaaattcctggattcttccgaaaggatttgcaaaaaacaatgacggaaggacacagatcctctgtgaaaatgctatgttccgaattgattcacagaaccgcggtgtggaaatgtttgaccatgagaaacagcgcacgcccaactcttattttatcttaaataactgcggcaggccgagcggatttgggattgagccgattaacgacttcatctattgtctgcaaaaagatattcctttcattgcagacggtaatgacgggctgcaggcggaattggtagcggaggctgtacacgaaagcctgaagacaggacagaaagttcaggttaaaagagattaaaacacagaagtttatcttatgacaatttatcaaggaaaagattataaagaaatttgtcaaaaagcggcagagatcattgcttccgaaataagaatgaatcccagggcagttctcggactgtcaacggggtctacaccgatcggagtttatgaccggctggtggaatggcatcagaagggacagcttgatttttcagggctcaccaccattaatctggatgaatataaaggactcggggcagaagaggattctgataaagcatgccgtgagtatgaggagatcatcgcagaaaagggaaggattgatcttcagcttcttgggctgggtgctaatggacatatcggtttcaatgagccgggggatgcctttatttctgatacccactgcgtgaaattacgccgagagtcccggcatcaatccttaaacttcatcctcatactgccatatttgcggatgaggaggctctctctgtgatcaaagaaaatcataagctaccaatagtataatacagaaatttcatagggtgaggtcaaaagttctcaaagagtgtctgtctttgggaacttttatttgattggaaatatcttatgacatataataaatttgagagtcattttgcattttttgtataaaagggaagggcggttgcggtaagatgttggatcaatcagaaatacgtgcgttggcagatcaaaattcttataaaagaggaagaaacctgtatcgttcagacgctgttctggaatattccgtggaggaagacggccaaattgattatatatacgccgccgtacagggcagcggcagaaatatgtatgaagtcgatttggaatataatatggaagaagggtggctggaaaatgcgtactgcacatgtccggcgttcagagaatatgagggattatgcaagcactgtgtagctgtcttgtttgaatatgcagattacttagaaacacaggaagctgtctggcagtatgaacagaggaaagaagaaagccttgcaaagcttcagataatgaaagacatgaagaataaacttatggccggtgatggatggaaaccaaagacgactccggctatgaaggcatttctttcacagcagcagctcaaaagcaccctgcccatcgtccaggaagatatttatggaaaagtgcatctggaaccatttttaacatgcacggacaacgaaatctatttggagtttaagatcggaacgtcttatatgtatgtattaaaagatgtctttgcctttgcagatgctttacagaataaacagaaattcgcttatgggcagaaactggaatttattcatgatatggaagtgtttgacggtgaatcaagaaaactggctgaatttatacagtcgtggactgctcagaaccggattaagtatatgcagatttcttattatgggtattcatatacagattccacaatgaaattaagaaaagcccctttgacaacaggggatctggaattgtttttagaagcagtgggagaccgggagttttcggcggaaatcagcaggatgccggagaaactctggcatgtgacaaaggattcactgtgcaggaccatgaagattacaggtcaggaacagggaattgacgtagaggtcaactatttgttcggattccagggcatcaaacacaatatttatttttgcaaaggaaagatctacaaagtaagcagagcgtttttggagcctatcaatgattttttgtcctgtatggcaaatctgccgcagcggaaggtttttatagaaacggcagatgtgcctgtgttttgcagagaagccctgcccgtgctggaaaagtattttgactgcacaagagagagctttgacgagaaggactatggggtagtgccggccacatttgaagtatatctggatgcacctcaaaaagattttattacatgtaagctggatgcggtgtacggagaacagaaataccatgtttttgaaaagaaccagaaaacagggggccgggatctgaaaaaagaagcagaagccgccaggatcgtttcccgttactgtaatgcctatgatgaagatgaaaaaaccatggtcctggccaatgatgaggagatgctttatgaattgctggtctacgggattcctgccatgcagcagtttgcagaagtatatatttccgacgccctgaagaaaatcaacattgccccggcgccgaaagtggctgtgggagtatctctttccggcgatctgctggagttaaagatgaccgcgggagatatgccgagaaaagagcttttggagatcttatcaaaatacaatcggaaaaagaaattttatcgtttaaagagcggtggtttcgtgaatatggaaggggaggggattaatgccctgctggaaatgaaagaagggcttcacctgacgaaaaagcagctggaacaggagcaggtgatccttccgaaataccacgccctttatctggacgaggagctgaaagaatggcagtcggtttccgcccacaaggataaagagtttaaggccctgatacggaatatgaaaacggtggaggacaatgattttgaaatccctgccaaaatggaacttatcctgagagaatatcaaaaaagaggatttttgtggatcaagactttaaaatacaatggtttcggcggaatcctggcagacgacatggggcttgggaaaacacttcaagtgattgtatttctgttatctgaatacctggaggaagaaggaaacagtccaagtctgatcgtggcccctgcatcgctggtatttaactggcagagcgagatccgaaagtttgctccggaccttccggtccagatggttgtgggaaaggccggagacagaaagtctatcatcaaacatgcaggcagccgggatatcctcgtcacttcctatgatctcttgaagcgggatattgacctctatgaaaatatgactttcagcaaccagatcattgacgaggcacagtatattaagaatcataatacccaggcagccaaagcagtcaagatggtgaatgcagggtttaagctggctcttacaggaactccagtggaaaaccgcttgagtgaactttggagtatttttgattatctcatgccgggatttttatattcttatcagaggtttcgtgaagagttggagcttccaatcgtacaggataacagtgagaatgagataaagcgtcttcaaaagatgatcaggccctttgtgctgcggcgcttaaaaaaggatgtgttaaaagatctgcccaacaaactggaaaaaaattattatgccaggatggaaggggagcagcagaagctttatgatgcctatgtaaaacggatgcggttgatgctcgataagcagtcggaagaagaatttaaaagctctaagctccagatactctcggagcttacccggttaagacagctttgctgcagccccgagctggtttttgaaggttatacaggagggtctgcaaaatccgatctgtgtattgatcttataaagaatgcagtcagcggagggcataagattctccttttttctcagtttacatccatgctttctatattggaagagcggttgaaagctgaaaaaatctcgttttatacgcttaccggatcggtaaacaaagaaaaacgggcccagatggtggaagactttaatcatgacgatacttcggttttctgcatttccctaaaggcagggggtaccgggttaaatttgacttccgcggatatcgtgattcattatgacccgtggtggaacctggccgtacagaatcaggccacagacagggcacaccggatcggacaggaacatgtggttatggtctatcgcctgatcattgagggaaccattgaagacaacattgtgaagctccaggaaaagaaaaaagaattggcagagcagattttgggcggagaaggaatgggaagcgcaagctttaccagagaagaactgaaggaattattgaagtaaatagataaaggctgaggatttatgcacactaaaacaatcaggtattacaacgaaaatgccaaagaatttgtctccaatacagttggagccaacatggaatataatcagaagcgtttttgtgagaggcttccgaaaggtgcattgatgcttgactttggctgcggctccgggcgtgatactaagtattttatgagtcagggttatcaagtggaggcgctggacggatcagaggaactgtgcaggatggcttcggattttacaggaattgaggtgaagcacaggtactttcatgaactggatgaggaagataggtatgatggaatttgggcctgttcctctattcttcacttgtcggtaaatgagcttaaggaagtttttcctaaaatggcaaaggcattaagacatcaagggattgtatatgcttcatttaaatatggacatttcgagggagagcggaatggaagatattttacggacttgaatgaggagcgattgcacagattggtagatgatacaggagtttttattgttgaggaaacatggattacgtctgatgtaagaccggggagagatgaagaaatatggctgaatatgattttgaagaggagagaaggttatgttttggggggtgaatgagcagttagagaagagattgaaattgaaatgtaaagatatctatatatgcagccgaaaaggctgctttttttgtttattagaaaagcatttgccgtcctgtttctgttctgataggtatgaacctctggcttttagaatataaaagtctgcacaaaaaatattagaaagtaaacattttttggactgtgcaaattttgcatttctgtagaaagaaattgaacatttcttggactttacgagtgtattttcattagttaatcttaaagcatggaagatgcaaggaggtataaaatgtcaatctcgtataacttagatgtaagatgctatgaaatactggagtatttattgtacagagatgaatatatcacagtacagcaaattgcagaagaaaaagaaatttctaaacgaagtgcttattatgatatacgaaaaataagtgagtggatggaaacccaagggatagctccactagaaattgaaagaaaaaaaggaatcttgattgatgagcagaaaaaaggattaatccgtacaagattaagagagatctcacccaaacttccttacatattttcaccggtggaaagaaaaaaaattattatttgttctatattgcagagaaaccgaaatcttcatatcgatgattttatggaactttgtcaggtaagcagaaatacaatcattaatgacataaaggaagcgactaaagaaatctctaaatatcagcttctcctgacctatgaaaatggagaaggttatcacattacaggagatttagtacgaaaacggagcatttatttcttatattttaactccattgcagacttttataaaaaaagaattcttccattagatgctccagacaaagtacaacagattctggataagttaaaagacattgaagatgcactggatacccagtatgttgcaggaacgttatattccatagcagtttttttttcaaccattgaaaaccgaaccgatatcgttgaatttacagaaaatgaaaaactggaaattatgcatagcatagagtatgaaattgtatcaaaacaatttactgattttgaggaaagtgaacagttatatcttgcattacatctgcttggatccagaacgcagaatatttctgtcaatttcagaaatgaagaaagcggacaggagtatcagcggctttcaaagattttagttaaggcgttttcaagacttgcgggtattgaatttacaagagaagaggaattggtcgaagcaatagcggcccacttaaagacttcgttgtaccgttaccggtatggaatacaactgggaaatcctctgctgcatgatattaaaaatgagtatggtgatctgtttgaggtctcaagcagagcctgcaaagatttggaaagtgaaattggtgttcctattcctgagggagagattgcgtacataacattgcattttggagcatttattaactcagggcagcaaaaaaaacggaaattaagggtcttggttgtctgcccaaacggattaagtacagccaatatgttatgcggagaaatccacactttagttccaaatgcccatgcagttgatattatctcaatgaaaaattatcacaaagagcataattataatgttgtaatttccacgattgcaattcccgaagaaaagaatcttatcctggttcatccgattttgacagacaatgataggattttaatcttaaaaaaatgtatgcggatagagaacagaaacagtgctgatatttcctttattgcaggacttgcagcaaagtatatgacacaggacaatctgcgcaaatttaaaacagaattaacagattatttttccaatacggcaattaagacatatgtaaaaaagggaaatcaacacaaaggaatctgccagatgttggaggagccttttatccgcatcgttgaggaaaaaatgggttgggtagaagctgtcagaatgtcaggagaaaaattaatcaatgatggttatattcttccctcttacttagaaagtattgtggataaaacaaggcagtatggaccatatatgtttattacagactctgtttttcttgcacattcagatattgaagatggttcaaaacatttggggatatcatttactatatttaagcagccagtattattccatacgttggatggacaggaacgaaaagcaaagattattttgactttatgtgcagaagatcaggtaacgcatatccgaatgttaaacgacattatgacgatttttgaagtacccgaaaatgcagaaaagatttggaagctgaaaagtgccaagggtataagaaataccatctgtaaaattgtacaggaggagacatgaaagaaatatataacatgctaaaaaaggaaaatatccagattatatcgaaagtaaaagattggagggaagcaatccatgtagcagtgcagccattagtaaacggtgggtattgtgaagcaagatatattgatgagatcattaagaacactgaaaaattaggaccttattatgtactgtgcgagaatctagcattggttcatggaagtacagatcagggagtactaaaacggcagattgcaattacattgttagaagaaccaatcaaatttaaagaggatggatacaatgtaagagttatggtgactcttgcagcgacagattcagactctcatatggaaatccttcaggcaatgtcgcaattattttctgagcaggacagtgtgcagaatatattgaatgccagaacagaaaatgaaatatatgatttgttcattcacgcaactgaagacaaataggatatcagacatctcataaatataggaggatttaaaatggattttattattaatattttatcaacaccagcaattttggtgggtttcatttctttatttggattgcttttgcaaaagaagccggccgaggatgtagtaaaaggtacagtaaaaacaatcgttggatttctagtattgacagctggatcaagttttctgcaaacagggtctttgaatgattttggaacaatttttaattatgcattcaacatgcagggagttgtaccaaataatgaagcgatcgtatcattaggcttaaaagagtttgcacaggataccgcttatattatgtgtttaggcatgatcgccaatattgttctggccagattttcgagactgaactacatatttttaacaggtcatcatacactgtacatggcttgtatgatcgcggttatcttaaatgtaggaaacttaagcgggcctttattatggattggcggaggtctgatgcttggacttatcatggtaatctctccggcactttgccagccaacgatggaaaaaatcactggtacgagtgagctgggatttggacattttggaggatcagggtattggttttcggcacagataggaaagttatttaaaggaaaaagcaaatcaacagaggaggttaattttcctcagagaatctcatttttgagagatacaaccgttgcgattggattgactatggtaatcttctttatcattgttacatttgttgcagttgtagtgagggatggaatgagcgatccaaccatcgcggctttcttccagggtgaaacaaatacacactggttggtatgggcaatcacaaaaggattcagcttttctggcggggtatatattatcttaagtggtgtccgtttgatcattggtgaaatcgtacctgcattccgcggtattgcagaaaaacttgtaccaaatgcaaagccagctattgactgtccggttattttcccatatgcgccaaatgcagtgctgatcggctttctgacatcatttgtaggcggaattttaggattatttatacttggagcgatcaacaaagcgttgattccggtggcattgattttacctggtgttattcctcacttcttttgcggtgcatctgctggtgtctttgccaatgcagaaggcggattaaaaggctgcttggcgggatcatttctgcacgggctgctgatcacattccttccggcgatttgtatgccagttatgggatctttaaattttgcaaactgtacattttcagatgctgacttctcaatcttgggaattatattaggaaatataacaaaatttatcaaagacggcggtttgtttggagtatgcatcgtattattcctgcttccaatcatttttaatatcgttgcaccaaaaaaacaggtacaataatctaatttattttaggaggtaatcgttatggtacattcaatcatgtgttgttgtggttcaggattaggttccagcatgctggttcgtatgaatgtggaaaaagcacttaaaaaacttggagcttcagggatttcggtatctcattcatctttatcggatgctgcagaaggagcggcagatttatttgttgtcggaaaagaccttgctaattttgtaaaggagctgccaagagttattattcttgacaatatcatggacaaagcggaattagaaacaaaattgaaagcagagattgagaaagagtaggcagaacttatggagaaaagtgaattgcagcagttaaaggtactttctgcccggatccgcttggatgtgttggagatgctggaaaagcgcgggtatggacatatagggggctcattatctattgtggaattgatgagtgtattatacggaaaacagctgaaatatgatccccaaaatcctaactgggaggatagggatatggttgttttatccaaaggccatgcaggaccagtatggtattctgcactagcagaaaaaaattttttcgacaaaggatggctgagcactttaaatgatggagggaccagactgccatcgcatcctgaccgtttaaaaacaccaggtgttgatatgacgacaggttctttgggacaaggaacttctgcggcagcagggattgcaacaggattccgaatgaaaggatctgaccaatatgtttatttgattgtaggagatggtgaattaaacgaagggcaatgttgggaggcatttcaatatattgcacattaccgcctcaatcattgtattgttattatcgatgaaaacaagaaacagttggatggaacaacaatggaaatcatgaatccttttagcattgccgataagatgaaggcctttggatttcatacagaaacagtaaaaggagatgatgaagaagcaattaatgaggctatctgcagggcaaaagaagtaggtaatcaggcagtgtgtattgttttagatactgtgaaaggagcaggggttccttattttgaacagcttgcagggaatcattcagtcaagtttaataatgaagaaattctggaggcaaaccatgaagccatgaaaacactgcaaaaagtcattgaagggggtgaaaaggaatgtttaaattagctgaaaacagacaagaaaaaggtcgagaattacgctattgcgtagttgaaactttacaagagctcatggactcagatgacaaagtggttgccatggaagctgacttgggcggagccagcggatttacaaagatccagcagagcaatccagaccgatttgtacaatgtggaattgcagaagctaatatgatcggcgttgcagcaggtttatctgttacaggatttaaaccttttgtacatacttttggcccgttcgcaacaagaagagtatttgatcaattgtatctgtctggagcatatgcagaaaataccatcaatatttatggatctgatccggggtttgcagtcggggcaaacggaggaacccatacaacatgggaagatgtggcattgatgagagaaataccaggagccgttgtttgtgatgcagctgatgacgtgcagatggaatggatcttaaaagaatttgcggctatggacggaattcattatgtcagaggaaaccgaaaagatgtcagaaacgtgtatcaaaaaggttctggttttaccattggaaaaggaaatgttttgaaagaaggagaagaaatattattggttgcatctggtcagttagtatcagaagctatggattgtgctgaacaattagaaagggaaggccattcaattgaagtaattgatatgtttacgatcaaacctttagatacaaaattgataaaaaaagaggcggagaacaagaaattaattattacatttgaaaatcactcaatttatggaggtttaggaagtgcggttgctgaagtaatagcagaagaaaatattccagtaccgtttaagcgagtaggtgtaaatgaaagattcggacaggtcggaacgccggaatttttacaagaggaatttgggctgacggcagaacacttgaaaaaggagatagagaactatttatagaagcattcaaaaatgtagataattgatttaataggagtatttttaataaacctccaaactgatataagatgaacttatcagtttggaggtttttataatatcaaaggcgatcttacatatatcctactctttcccatcccaacaataagtacaaagtttcttaggatctaatccgacagactcaatcatatcatccagcctgtgataccggagtgatgtaaaattcagctgcttacagatctcatctatcataccctgatattccggggagtccggatttgaaaacttctccagatgtacattcttgtaatctccgctgatctgttcaatgatccggcgtgtgatcagatccatttcagaagtagaccgtgagaaattcaaatatttgcatccgtatatgatcggcggacaggccgggcggacatgaacctcttttgcaccgctctgataaaggaattctgtggtttcccggagctgggttccccttacgatggagtcatcaatcaataaaaggcttttatcctggatcagttcgtggaccgggatcagtttcatcttggcgatcagattccttttgctctgtatggtcggcataaaggaacgaggccaggtcggtgtatatttaataaatggtctggaaaatgggattccggattcgttggcatatcctatagcatgtgcggttcctgaatcagggactcctgccactgtatccggtgaggcatcatcacgctgagccagcttctttccgcactcatagcgcatttcctccacgctgattccttcataagaggacgaaggataaccataataaacccaaaggaaagtacagatcttcatatcttcgcctggctttgccagagtctgaatgccttcgggcgtaagaatcacgatctctccgggaccaagctcacgttcggccacatatccgagattcaaataggcaaaactctcaaaggaaatacagtagccatcgtcttttttgcctacagcaatcggagtgcggcccattttgtctctggcggcatagatgcctttcggtgtcagaagcacgatcgtcatggaaccgtcgatgacatcctgtgcatgctgaattccttccacgagatgttctttctgattgatgatagcagcaaccagctccgttgcgttaatatctccgccgctcatttcaagaaaatgtgtgtggcctgaatcaaacatctgctttataatttcatccgtgttattgatctttcctactgtcatgatcgcgtaagtaccgtggtgggagcgaacgatcagcggctgcggttcgtaatcggaaatacagccgatgcccatatatccgtgcattttgttgacgtctttgtcaaattttgtccggaacggagcattttctatgttatgaatggcccggtcaaaaccgtcgtctttactgtaaaccgccataccggcacgtcttgtcccaagatgggaatgatagtctgtcccaaaatataaatcaaaaacacaatcctgttttgaagtgacaccaaaaaatccgcccataaattcctccgttttgtaaataaaattatattgctgtatttattataaccaaacggaaggaacgggacaaggaaagattggtattctttcgaaatgggaattgatttaattcaatatattcattataatacaaacataccgttaaaccgagacatacgaaaactttatatacaggggtgctggcagactgccggctgagagtaagacgagaagaagtctttaacccttatacctgatctgggtaatgccagcgtaggaataaaacagtacagttgtacatgagactatttccccgttggattttatccggcggggtttttatttcatagtaaagttctacgaccttccctaatgaaataaaaatgctccgcaggttgtgcacagatgcgcaaggaaattatttgcctttggcaaattgcatccggcacgcaaagttgtcaaggaaacagatttatgaggaggaaagaaatatgaatgcaagcgtagcgatccaaacactgccggaggcagccaatgacgaagaattgatccgtattgtggatcaggtaattgattatattaagagtacgggactgaattattatgtgggaccgtttgaaactgcgattgagggtgactacgatgaactgatggacattgtgaaagagtgtcagcatatcgctgtccgtgcgggtgcaccgtcggttgcggcttacattaaagtgtcctataagccagaaggggatgtgcttaccattgataaaaaagttacaaaacaccaccaataaactgtggccggcagcggcgatccttgtgcttctggcattatggcagactgccagcgggacagggatggtttcaaaatttctgcttccgtcgccggtggatgtggtcaaggcatttgtgaatgatttttcactgctgatgacgaatgcgagagtgaccataattgaatcgtttatcggtctgctgatgggcgttgtcattggtttttttatggcagtgctcatggatcatttcgataaaatgtataaggcattttatccgctgatcgtgttgacgcagacggtgcccacagtggccattgcgccgctccttgtattgtggtttggatatgaaatgcttccaaaggtaatcttgattattatcgtgacattttttccgattactgtgagcctgctggacggctttcgttcggcggacaaagatacaatcagtctgatgcgatccatgggtgcgtcaaagctgcagatattccggtatgtgaaatttccgggatctctgggccagttttttgccagcctgcggatttcagcttcctatgcagttgtgggagccgtcatttcagaatggctgggaggatttgaaggtctgggcgtctatatgatccgggttaagaaaggttttgcatttgacaaaatgttcgcggtgatctttatgatttctgcgatcagtctgctgctgatgtgggcagtcaattttctgcagaagaaatgtatgccatgggagagccgggaatagccgaaaaagtgaaaagaggatgatgattatgaaaaagagaatgttagctgtattcctttctgcattattagctgtatcaatgactggatgcggatcaaagaaagaggaagccggagacggaaagcttaaaaagattacatttgttctggactggacaccgaatactaaccacacaggtatttatgtggcaaaggaaaaaggatattttaaagaggccggcctggacgtggaaatcgtacagccgccggaggacggagcagaagtacttgtgggctccgggaaagcacagttcggtatttcatttcaggatacaatgatgcctgctgtcgttggagatgatgcccttccgatcaaggctgtggcagcagttttacagcataatacatcggggatcgtttcccggaagggggaagggatcaagcgtccgaaggggctggaaggcaaaaaatatgccacatggaatcaggatattgaaaaagcaatcttaaaacaggtggttgagaaggacaaagggaatttcagcaaggtagaaatgatctcgagcactgtcaccgatgaggtctctgcattaaagagcaaaaaagtggatgccatctggatctactatggatgggcggggattgccacagaggtggccggacttgatacagattactttgcatttaaagatattgatccggtctttgactattatacgccggtgatcattgggaacagtgaatggatgaaaaagaatccggaaacggcaaaagcatttttgtcagccgcaaaaaagggctatgagtatgccatcgaacatccgaaagatgcaggagatattctctgtgaagcctcaccggaactggattccaaaatggtacaggccagccagaaatatatgaaagaccagtataaagccgaagtgaagcaatggggctatatcaatccaaaaaggtggaatgcattttataactggatcagtgaaaaaggtctttcaaaaacgaagattccggaaaacaccggatttaccaatgactatttggagtaaagaaaatgtcggatttgactgtaacggatgttacgcttgcatatgagaatacaaatataatagaagacatcaatatagagctgcatgacaatgagctggtctgtctgctgggagccagcggcggagggaagacgactctgtttaatgtaatttccggactgaaaaaacctgatcagggaaaagttatgctgaacggcagggatattaccgggcggccggggcatatcagttatatgcttcagaaagatttactgcttccttaccggacgattgaggataatgtagcactgccgcttttgattaaaggtgagaacaaaaaaactgcccggcaaaaagccggggcactctttcaggagtttggccttgagggcactcaggaaaagtatccaaaacagctttcaggaggtatgcgtcagagggccgcactgctgaggacctatatgttttctgaagatgtggctttgctggacgaacctttcagtgcattggatacactgaccaaaagtgatatgcaccggtggtatctggatgtgatggataagatccatctgtctacgctgtttatcacccatgatattgatgaagcaattttgctttcggacaggatttatctgctgaccggaaggcctgggaggattacggaagaaattgtgatccgggagccgaagccccggaggaaggattttaatctgacggaagaatttttggagtataagaaagatatattaaaaaaactttagacagatatgattatattgatacaggcccttggaaaatattatatattgttttccaagggtcatttttataatctaaattagagagataacatatgtaaacggatgcactggggctgcatccgtatttcatttctcaggagaaagcttgttatcgtatgaaggttccattttcagtacaatatttgcacaaaacaagaaaaaaagagtgatattaattgctattttctgaaaataataatgagaatataatgaaatcacagagaaaagtgaaacagtcaggaggagcaaacatgtacgaaaaggaaatgatcattaataacaaaacaggacttcatgccaggccggcaacagacttatctacattatgtcaagcttatgaaagtgatataaaaatcagggcagaagacacggaaatcgacgccaaaagtattatcagtattttgtcagggggaatatgtaaaggcacaaaaatcaaacttgtagtaaatggaacagatgaaaaagaagcaggagaaaaaatcagtgaatttattgaaaatttaaaggagtagattgctttggaattaaaaagcagaccggcatatattttaaaaattatactggaacaaaaaaagggttatactgttgaccgcattattgagaaactaaatattacaaagagaacattttactatgacattgaactgatcaatgactggctgcaaagcagaggattagggaagctggaaataaagtcaaaagttatctgtgtgaaatcaaagaaaattgaaatgttggaagctgagatgagaaagaacggaagttattattattccgtacaagagagaagaatactggagcttttgatgatactgctgtctgctgaagttgtaaccatagagaaaatgcagaacctttttgatgtcagcaaaaatacgatcctaaaggacattaaagagtggaaaaaaattttggggaaccaggacatttccatagcaagttcaatcaagttcggatatgtactccagggagaagaatttgcgatcagaaaaattgttggaaaggaaataaagaaactaaaaaattttcagcctaaagatattttaaaaaagtggatgcagaaatctttggttacgataaccggggaggactatgattatctggagatcgccagatgtctgataaagcagtatgaacaagacgaaaatatcaaactggttttggaaaatgaagagctggagtgcagcatgatcctgatttcctggatcagaagcatggatggttacacgatgaatcttcatacagaagaaaaggtgactttagttgagacaaagccgtatcaatcgctgaaacagagttttgaaaaattaaaagtttataacttagaaattcctgaatcggaaatatattatattgcaacgctcttgttagggataaaggttgcacagtttgtgtctcaggatcaggaagatttgtatatttctaattttacaaaggcgcttgttgtaaattttgaacggattgcgtgtatttcttttgataataaagaccgcttaatgacaagattaaaagggcatatcagaccattgtattatagattgaaatatggagttcaatcgacaaatccgctggtacaggacgttatgagaatgtatcccgaaatatatgatttcactgggaaagcagtgagagagatgaaagatgaccttgccaaaatgttaacatcagatgagatcgcatacttaacaatctattttataagcgatgagaagtatcagacaatccaaaagaaaagcagcgtctctaaggtcttagtactctgcgcagatggaatggcaacctcaactttggtaaaagaacagctgaaaacactgtttggcagtaccgccgatattaaattgggcattatttctgaagctaaaaaatataatctggacgattttgcactgatcatttccacgggatattcagagctgctgacacaccggaaaaatattgtgttcaccaatgttattttggaggatactgataagaaaaaaattatccaggtcatgaatcagtgcggggtcatcggtgagtataacaaaacaattcaaagaattatatcggcggccattcggagtacaaatggtattgttgatgaaaatgaactatattttgacgtgctgcggatattatttgaatctgataacagaaagatagacaaaaaattaaattccattgcagattatattcaaaatgaaaggtatagcgtactgtctgcacacagcaccaaagaagagctgctcatgctgggatgccagaaagcggttggagaaaaagcgtggaagcggctgtataacaggttatgcaatatgatgaaccataacaaaataaaattttatgaaatttctcaggatgttgtaatactccattgtcccatgcgcggagatttaaatgtagaaataaattatgaaattgttgtttcagaagaaaggataaaaatatctgaagagataaaagggaagatatttattttctttgtcaccgtagatcagaatacacatttccctgtgctggaaggtatttatcgttactgtgagagtgaaaaggggaaaagttttatcaatgctatgaaaggagttaaaaagtgaaaaaactgagaggagttggaggtgctgaaggaaaagctgcgggcaccattctggttttaaacgagttgaaatatgaagttaaagctgaaaagactgacgatgctgaatatgaaatcagccgctttgaaactgtaagaaaagaatataaggaggagctgaaacaactgtatagagaggcggaggtttcagcaggggaagagcctgcaaacattttcctggcttatattgaaatggtaaatgatgatgctttttttcagaaaattatcaagagggtacaaaatgaaaaacggaacctggtttatattttggaagaggagaaaacagcagcagcggcactatttaaaagtatggatgatccatatatgcgggagagggggactgacatcgaaaatgtctgtaatgctttgatcaggaagatggaaggattaaattctccgatggatcaggttgaaaaattaaaagaagatgttgtgattgtcgctgcagatctgacacccgaagatatgatccggatggacacaacatatgtaaagggctttgtaactgaaagaggagggaacacatctcatacggtgatccttgcaaaagcattagggataccggctgttgtgggtgtgaaaaatatattggatgaagccggttctaaaactaatatttatatggatggcggtgaaggcacgataattatagatccggatcagtagttatcggacatcctttgagaggaggtttctatggaaaaaaggtgcatatactgtggacagccgatcaccaaaaagccggcagctgtttggctgaaaagggaaaaagaagaagtccagtgctgcagtatggactgttgtaacaaaacgtccagatttattaagtgggataatgcatcaaggcttaaagcatatgtaatcattggaatatgtgctgctgtcaatttaataaacatcggtttgtcgatgaaaggctggtggacacatataccgctggtcatcatagggatttgtttatgtaagtggccgctggtatttatgcattttcataactatgaaagatttggaatatggaaaacgctcaagtatgttcgttttgcagcaggggcgcttattgtgtttggagcagttattacggtatgggatatgtccttcttataaaacaggtataaaaaatgtaaaatcagtgaaataaaaagtgaaaaaaactgctctttttgttaaaaaacatcagtgttatagtatatttagaaattaagttatcggtaactaaatattctattaaaatctaaaaatagaaagaggtgacaatttttgaggctgctagatgaagaacttgtaattttggatgcagatgttaaaacggcagaagactgtattcggctcggaggaacgattttttatgaaaaagggtatgtaaaagatggatatacacaggcagtgatagaccgggagaaagtatatcccaccggtttgcccggaaaaggagtggcgattgcgattcctcatacaaataatacatatgtaaataaaccggcagtaggtgtcatcgtacccagagaacctgtaagattttgtgcaatgggaacaaaagatgtgtggctggattgtgaagtgattattcctctggtaatcaaagattcggatatgcagatcagtatgctgaagcagatgatgaagatcattcaaaacggagagctgttgaagaagatcagggattctaaagacagatcagaaatcctggattgtttaaaaatcttagaagattagaaaggaagagaaattatgagagcaataaaagtattatcagtgtgcggttcaggaacagtgagttcagcaatgctttcttcaaaattagcagatatatttgaggaaaaaggatatgagatggaagctacggaagtgagtcccggaggagttccgggtgccatgcagggaggcggttatgacctgatcgtttacacaagccctgtggaaggaaactacggagttcccattttgaatgccacaggtttccttgtgggcattaatgaagaagaatttattgaagaattaatgcaggaggtagagagtctggaactgtagttttgaaaggcgggaaaacattcatacgaggaggttgaaatatgtgggatacactgaaactgttttttgatacattcggaaactatataacagtgccgattatcatatttattatttgtttaatattcaaagcaccggtaaaaaaggcttttatgtctgctgtgctgatcggtgtcggtttgaaaggtatggcgtttataaccagtgcgtttggcagcgtattatcagcgttagtaacaaaactgatcgagcagacgggaatcaatctgccggcgctggatgtagggtggcaggccgttgcttcggtagcttattccactgacattgggatgatgtttatcggagtcgggctgatcttccagattgtaattttcctggtaaagattacagatatctttcagccgtcggatctgtggaataattactcaatcatcgtgtggggatcgctgttataccagatcaaaggaaaccttgtgatggcatttgttcttatgctttttgtcaatttggttgtcttgctgcttgcagagattgtccaaaagcgatggtctacatactatcattatccaggctgtgcaatgatagcgccgcatcatatgggggatgtacctctgtacttagccttagactttgcacttgggaaactgggagcagataagattaatttaagaccggatgcaattaagaagaaaatcggatttctgggcgaaccaatgtatgtaggcctgatcgtaggactgattcttggaatcgtcggaaatatatcgactttaaatgagatgacttcatggggacaggttgcagatgttgcggtgacctgttcagcagtaatggcaatctttccaaagattgcgggattgtttgcctcaggatttactgtcattacggattactcaagaaaggcattaaagaaatcaaagtatggaaaggaccgggagtttatcgtcgcagtaaatgatgcactgggatatggagaagcggctacattgacaacaggcttgttagttatcccggtggcccttctgttagccttcattttgcctggaaatatcgttcttccggtaatggtattgccctctcttccatatatggtagaagttccggtatctctgtcaaacggcaacatctttaaatcctggattgcagcctgtattgtgttctgcgcaaagctgttaatggcatcctcctgggcagccgtatttacagacatcgcagtaaatgccggatatgaagtgactgcaggaactgtattaattatcggatttattctgtcaaactgtacggcagggcttattacatacgcattcctgaccatgaatccgatcattattggagcggtcatagctgtctatcttttgtgtttcgtattatttaagaaaaataaacaaagagtatgggattatttagaatctaatgctatgggaggagcacaggcagccgccggagcatcgggcggagaaactgcataagacccagtgcggatgatactttgaaacgaaaggggaaattatgaagattgcagtagtaggggatatcatcgtgagcagcggattgctggcagaagccgcaaaaagcctgaacattgatgatgaaccggaaattaaagaaattgtttggaaagcagatgaccgaaaggattttcagaaaaaggctttaaacatagaaacaaaggggccggaggcagaagagattccagaagaactttataccgaaatagaagatgcagatattctgctggtacatttctgtcccgttccgaaaaaattaattgagagggctcaaaatctaaagctgattggaacatgccgcgggggactggagcatgtagatgtggaagccgcaactgaaaaaaatattccggtggtgcatgtgataagaaatgcggaagcaacttcagattttgcggtcggcttaatgtttgctgagacaagaaacattgcaagagcccacgcagcaatgaaacagggcatctggagaaaagagtatgttaattcagcatataccactgcaatgagagaaatgacagtagggatcatagggctgggacatatcggacgtttagtggcggaaaaagccgccgggatcggcatgaaaatcatcgcttatgatccatttgtgactcaggatgccatgaatgccaaaggcattgctgtaacaatgaaagagaaagaagaagtgttcagagaagcggatattatatcacttcatttaagggtaacaccggagactgaaaacagtattaatgaagaagttatcagtcttatgaaaccgacggcgtatctgatcaacacatccagagcgaaggtcttagataaaggggcatttattgaggcattagaaaataaacggatcggcggagcggcattagatgtgtattggaatgaaccgctggataaggacgatccgcttctgaaactggataatattactttaacgccgcataacgccggaaatgttgtcgatgccctcccaaaatctccaaaactactggtagacacgattaatcgtttttgggagacaaaaaccagtgatatgatagtcaatttaaacgagatcacattttaaaaaggggaacaatatgttattaaaaaaagaaagagaattggtagtcgagtacggcaaaaaaatgagtgcagccggtctcagcaaggggacaagcggaaatatcagtatatataatgcagaagaaaagatgatggcaatcagtccatccggcgtaggttattttgaaactgccccggaggatgtcgttgtgatggatttagaaggaaatgtcgttgaaggtgataaaaagccttccagtgaatgggggctgcacacagttttttatgtaaataaaccggatgcaagggcagtcgtacatacacattctgcttattgtacaacatttgcatgtctgaatatgccgattaaggccttgcattatgtcatcggaggtgcgggaacgtcgatggtaccgtgtgcaccatactgtacattcggaactccggagcttgcggaggtagcgatcaaagcctgcggaaaggggaaagctgttttacttgcaaatcatgggcttttgacttgcggacccggaattgaaaaagcatttggtctggcagtgaatatggaattttgtgcggaaatgcagtatcgggcaatgtcagtcggtgaaccggttgttttaagtgacgaagaaatgaacgtggttatggagaaattcaaatcatatggacagccaaaaaaaggcaaagaagatcagacatccaattgttactgatgtttcaatcccggtttccgcttttggagccgggatttccaatttaatttaaggaggagcagagtcccggaatgaaaatgagaagagcagttttgtatgaacaggaggatcttcggattgaagaatgtgaggttcctgaaatcggagaaggagatgttttagtaaaaaacaagatctctgccacgtgtgggacggatgtaaaaatatataagaggggatatcctttattgaaaccaccgcatccattcggacatgaatactcgggagtgattgccgcagtggggaaaaaggttaagaattttaaagagggagaccgggtagctgtgcacaatacagccccatgtaatcattgttatttctgtaaaaagggatttccttctatgtgcgaagacatgttatttaacagagggacctatgcagaatatgtaaaagtaccggagagaattgtagaacagaatatgtttttgcttgatgattcgatttctcataagagtgcttccctgatggagccattttcctgtgctgtatatggaatagaagaatgccccattcacttaggtgatgtagtagcggtaaacggtgcgggtccgatcggtttgatgtttgcgaggcttgcagtgttaaaaggcgctcatgttattgttacggataaggcacaaaatcgattggagcttgcaaagaagctgggggttcatgagatattaaatattacagatattgaggacagcgcatatgcagtaaaagcgatgacagaaggaggcaggggagcggatattgtaattgaggctaccggcctgatcaatgtatgggaaagcagtgttaagatggcaaggaaagccgggtttgttcttttattcggcggaacaaaggaaaaaagcatcctttcgattgatgcaactcttctgcactattcacaagtaacggtcaaaggtgtatttcacacaaccccgagacatgttcgaactgcgttggagttgttaaaaatgggagtgatccaaagtgatgattttattcaaaaggagtatccgcttgagaaactggaagaggcgatacttgaacatgcggcccaaaaagtaattaaaaattgtattgtttactaggcagaaaaggatggtgataacatgtattctataaaattagggtgcgaaaaaatttactgggggaagaacgctgtacaacagcttaagacactggaaggaccaagaaaaagagcatttattgtcatgagcggaaatgttcttatagatgtcggctcctataaaaaagttacggatgttttagaagaagccggttttgaatacgaggcctacacagaagttgaaccggagccaagttttcatacaattttaaagggtgcagaaaagatgaagacttttgaaccggactggattataggatttggcggcggatcagcaatggatgcagcaaaagctatgtgggtgttttatgagaatcctgcctatcgaacactggaggagacaatgcctccgaatatcatagagaatttaagagtgaaagcaaaagtctgctgtattgccacatctgccggaacaggaagtgaggcaaccagagcagctttaattaaggatattgaacaaaagaaaaaatattctgtcagagacatgaatggaagactggttccggatgcagctgttttagatcctgaatttacggcaacgatgcctaagagtttaacggcagcttccggaatggatgccctgacacatgcaatagaatcttatgtaacgccaactgcaaatccattttcaaaggcaatgtccctggccgcttttctttatggatataagagtctggaaaaagtgtacgaaaatccggaagatgaaaatgcaggggcagagatgttggccgcatcctgcatgggaggaatcgcattctctaattctggattaggaattgttcatgggattgctcattctttcggggcggaatatggagtgccccatgggcttgccaatgcgattgtacttccatacggattggaatataacagtcggaatgatgaagttaaaaaaatgtacgacgaacttgcaggatttataggaaaaaaatcattggcggatgcgattgccgagctgagcgagaaaatagatattccaaaaacaatgaaagaaaaagtacaggaagacacttttattaagaatttggataaattaacagaaaaagcaatgagtgacgtggcaacgccatttaatccgattcagccaacggcagaagagatgaaggaattaattcttaaggtatactatgggaaagatactgtgaacagcttgtaaaggcttagtttcatattttgtcaaagctaacctttgagatcaattgatttcagaggttagctttttgaaagaaaatctttaaaaattcgtcaaaccgcatggaaacggggattttgtgcggacagcattaagactcatattttatattgtctggctggggactcctgtttacttgggcagtaacgtctgctgtactcttaagttccttatgaaggtgcagagccataaatactgtaataaccccagagataacatcagcaatcggctgagcataaagaattccgctgataccccaaagtgccgggaaaataaagatgacagggacaaagcagattccctgcctgcatgcacccaggataaaaccttcctttgcttttcccagagcaaggaaaagggatgaatataccgtatagaaaccaaagagcagaaaagataaaccgtttgcccgcagtgccttttggccggcacggatcatttccatatctccttctgtgaatcctgaaatgatagatgaggaaaacgaagccgcagctgccccaaagattacgcagaatattgtggaccatataatagaagttttgaccgcttcatgtaagcggtcatatttttttgccccatagctgaatcctgcaattggctgaaagcctttgataaatccgaagaccatgagacttgccatagaaataacccttgttaccacacccatagcggcgatgacggaatccccgtatactttcgtctgtttgttgatcagtgcgatggaaagactggtcagcagctgaaagatcagggtaggaatccctattttcatgatttccgatatcatttttttagaaaaacagcagtcttttattttgaaatcaaatacacttttctttctgaatacataacataaatacacagcggtagaaactatttgtgagatggccgtagcgattgcagcaccggccacgcccagatccaggacataaatgaagatggggtctaaaataatattcagagcagcacctgtcagcagggcacacatcgttgtcttagcggacccttcattggtgacaatattattcattgtcacattaaaaacgttgaagatagatgagacaatatagatgcctgtataagtgactgcatagggcattatgcttttggttgctccaagcaactttaaaatcggattcagaaaaatcaccgtacaaataattaagactgcacctgcagccacactgctgtagagagctgtactggcgactttgttggcagtatctttttcttcgcgtcccagcagtctggaaacataggatgcggctccgtttccgaataacaggcccagtcctaccaccgcctgtccgaggggaaaggcaacggagattgcgcccatctggctggttcccagccctcccacaaagtaagcatctaccaggttgtataaggcattgatcatcatgccgatcatagtcggcagccccatggctaaaagtgctttcggtatcggagcacctcctaacagttccatctttttgttttgttcattcataatgaactctcctttctgttgacatgaaatataaaatatactactataaattatagcaagtaaatagtgaatcacatactactataaattatagtagttgtcaagcaaaagggggaaatcatggcaaccattgatcttatcgtgctgggaatcttgaagaaggaatctttaagtgcctacgatattcaaaagatcgtagagtaccgcaatatatccaaatgggtgaagatcagtacaccttctatttacaaaaaagtcatccagctggagaaaaaaggatttatgaaaggcgatattgtaaaagaaggaaatatggcggaaaagacggtttattctttgacggagcagggcgagaagcaatttgaaaagctcatgctggagatcgcttcaaaacctgtccgaatatttctcgactttaatgccgtcattgtaaatctggacagtctgccgaaggaaaaacagaaatcctgtttgacagagattgagaataacatgaagactttaaaaggatatatcgaagaaaatgtaagcctgaaagaacatctgccggagattccgaaaacaggaatggctgttttagagcagcagcttatcttggcacaggcgctggaaacatggattgaggaactgaaagaaactctttaactgaaagaaaaatttaggagggtaagttatgtttgaatcaagatgcggtgtctgctgcaattcatgtgaacgaaaggagcaggttcactgtaaaggatgcacagaaatgaaacagccgttttggggcggtgagtgcggggtgaagtcctgctgtgagaaaaaaggattcgaccactgcggagtctgtccggatttcccgtgtgagatgctttctgctatgggcgtggaagagggatttgatccggaacctaagattacgcagtgcaggatttgggcgggagagagtactgttaagtaaacaacagaatatgagaatgaccttaagccagaagatttttcatcttctggcttaaaaactgtttacaaaatgtaaaaatagttgtataatacattcgaaagtacaaacgtccgtacattataacgttaggataaaatgatgggaggtgaacaaatagaattttaaaacaaaaggcagaagtcaatatttgaggaggttaagatgtatacaaatttgaagaaggttctgaaaaaagcggatgaactgaacatggcagtgggggcgtttaatacccacagtctggaaatgcttccagccattatcctggcggcgaaagaacaggggactccggtgatcattcagacgagtgtcggaacggccaaatatgtggggcacaagaatctggtatctgtgtgcagggccatgtcggaggaagcaggaattgacgtggtgcttcatttggaccatgcaaaagagtatgatgatataaaagaggcgattgatgccggttacagttctgtcatgtttgacggatcatccctgccgctgaaagaaaatattttaaagacacagcagatcattgaatatgcagggaaatttgatgtctctgtggaggcggaactggggatcgtcgggggaacagaggacggagtagcagtgtcagaggcggaggtgcgctatacagacccaaaagaagcagtggactttgtgaagaagacagggattgatgcactggcagtggcaatcggcacgaatcacggacagtataagtccaagacaaacattaactttgaaaggctgaaagaaattaaagaggcggtagatcttcctctggttattcacggcgggaccggagtaaaggatgaggacgtgagacgggtaatcgatcttggaatcaggaaatttaatgtgggaacagaacttctggtcacctggacgaaaaagtccaaagagctttttggacagacctcggaaagcagttctctgagaaataatgtagtgccgtgtatcgaagcagtcaaccaggtagtacagaggaaaatagaactctttaaaaatctcaattaaggcgggtgatgcatatgagagcaggatattatacaggggatcggacctatgaagtgagagaagtacctgaccgggaaccggaagatgatgaagtgaaaatcgaagtggcatggtgcggcctgtgcggcacagacatacataaatttgaagggaaaaacggggccagtccggtgataccgccgattattctcggacatgagtgttccgggattgtgacagccgtcggaccgaaggttaagtattttaaacccggagacagggtggcggcagatcccagttacggatgcgggaaatgtatttactgccagcaggggcttccgaatttctgttttgaaaggcacggtgtggcaaaaggattttctgactatgtgtaccctccggagcagaacgtctataaagtgtcggagaagctggatcttaaaaatgcggcattcgcagagcctttgtcctgtgtgatccacggactggatctgattcagatccgaagcggctcggcagtggtaatttacggtctgggctctatcggaagcctgatgcttcagatggtgaaactctcgggggcctctgtcatcatcgtggttgagagggagaaagagaaacagcagctggctcttgagctgggagccgattatgcagtggatgacaaagaaatagaaaagctggctgagacatttaatattgactatgttatcgaatgtatcggattaaaatcaaccatggagcagtctctgaagattgcgggaaaaaatgccaaggtactgctgtttggactcggagatccggatgagccggtttccatgaaccaatttgaggcgtatacgaaggaactcagcatctatacttcttatttaaatccaaacacaacgaaacgggcggtggcgcttttagaaagcggaaagcttgataccgatacaatcatcagtgccagccttgatctggaagagatgggtgaggagctgaaaacacagaggtatgcaaagaaagggaaagtgatggtccgcttaagcggaaaacattaatcggaaagaggaggatttaagatggtaatttcagcaattttagtagctttgctggcaacaatggggcagtggtggttttttggtccggtgacaaaatgtctggtgtacccactgacgacagggctgctgaccggtatttttatgggagatccgatgacaggtatgctcgcgggtgctaacatacagctgatctatctgggatggatttccgcagggggaaccatgcctagcaatacgatcgttgcagggatctttggtacagccatgacgattctatcaggcgcgagcccgacgatggcagtgacatttgccatcccgttcagtatgtttggccttttactgaatcaggtttatatgactgtgaactctttctggattcacagggctgatgttatgctggaaaacgggaatatcagaggagtgcggcttatgaattttgtcccgtcctttctggtggcctttgcgctgtatgggattcctgcctttgcgctcgtgatgtccgggaaaacatggggtactgctttgattaataccattcccaagagccttgtaactgcgctgcaggtagtcggagggatcatgcctgcacttggaatcgccatgcttttaaactatcttggaaagaaaaagctggttccgtatttctttgccggatttttcctgacgatctacttaaaactggatattatggccgttgcgatttttgcggcaatcattgcaattatcatgtttatggccgataataaaaaggaagaaaaaacgaagaaagtgaagcgcctcacgctgaagaaaaatgaagagcgcactgattatgcagaggaaacagaagcgagggattatcagaaaaaactgtcaaaaagagatcttgtaaagacatggctggccaccaccagcacagaggcatgctataactatgaacggctgcaggccctgggaatcgccaatctgatgatcgggccggtcaaacgcctgtacgaatccaatgaagagcgggtcagagagctgaaaaagtatatggtattttataactcagaagtctttactatcgggccgatcattaacgggatcacggtttctatggaggaggccagagccaacggggaaagtgtttcggcagaagacatcaattccgtccgcaccggactcatgggacccgtagccggtatcggagacaccgttatgcagggaatcctgtttcctattttagcgggtatcggctgtacgatggcgctggaccggaattatgtcggaccggtattttttacagtattgtttgagatcctgatttttacatgcggatatttcatgtttatgaatggctacaaatacggaaaatctactctgttgaaaatccttaaaaacggggtgattgataaggtgaccaatgccttcagcattgtgggactcatggttgtggggtgcatggcttccacaagaattacagtgaatactccgtttaagattgccgtgggcagcggtgtggtaaagtttcaggagattttaaactcccttcttccaggactcattcctttagctatcaccctgattgtatggaaacttgtttcaaagaagatcaacgtcacttggatcgttatcggcatcttcattgtaggaattgcggcatcttatctggggctgcttggatttgtgggatagagggatgccgttatgatacatattatgttagtaagccacggccgtttctgtgaagggcttttagaaagccttcaaatggtggcaggggaacaggaggggatatcagctgtccctctcctgcccggagagtctccggaagcatacagaaacagactggaaagtgagataaaagagtacgaatcagaggaaggtactttggttcttacggatgtgacagggggaaccccttttaacagtacaggatacctggcgaaagaccataagatcggtgtggtttcaggtatgaatatgccgatgctgatcactctggtttttgccagaaccgaaaagagcacgctggatgaactgatacaggaggcagtctctccgggggcattggcggtaaagggaatgaatttaagcaaaggaggcaggaagaatggaaaacttagtcttaacaagaattgacgaccggctgatccacgggcaggtgatgacagcctggatcaagcagaaaaatgcagtacaggttgtcgttgccgatgatgaagtggcagaagacgattttatgatcaatgtgctggaaatggcagtgcccgatgagattgccatcggtatatttaaccgggacgatgcggtggaatttatgaaacaggggctggaagcgcctacaatccttcttgtaaaagggccggaaatcctgaattacatggtggatcaaggaattgaaatcgatgagatcgacgtgggaggaatgggtgcaaaagaagggagaagtgttttgtataaaaatatttctactaacccggaagaaaataaaaacttccttgatttgatccaaaagggagttaatgtttttgtccaggttatgcctcaggataaacaagtcaatgttgcggagtatattaaaaagtaaaggaggcttttaacatgaatgcggagagattagatgataaggtaactgtcatcaccggaggcggaagcggcatgggagccgctatggcaaaagagtttgcaaagaggggagccaaagttgtaatctttgacctgaatgaagaaaaatccatgcaggttgtggaggaaataaaggccggaggcggtgaggcctgctttttcaagacggatgtgacgaagaaagagcaaattgatgaaaatacatgtaaagcagccgaaagatatggtagaatcaattcatggatcaactctgccggattttccaagatggcgccgtttctggaaagcagtgaggaactttgggatacgacgatcaatgtgaatctgaaagccacgttcttgtgctgtcaggcggcagtgagacagatgcttgacggaggcggaacaatcatcaatatgtcttcactttcagggaaaaagccaagttcctggcagaccatttactgcgcaagcaaatacggtgtccagggactgtcccagtccatagcaaaagaatttgcagacaagggcatacgggtaaataccatctgtccgggaattgtcccgacagagatgtggcagaagttaaaatatgaatatgcaaagaaaagaaatttagatccggaagaagtgctcccgtattttgagaagaatattccgatgcataagctggtagatctgaaaaatgtaacggatgcggcgatcttcctgactacggacagctcaagctatctgaccggacagtccatcaatctcgtgggcggggagctgatggaataattttaggaacacagttacagagaggtgtaagcgatgaaacatgaattggatttcagcggaagggaacagctttattaccagatatatgattatatgtatcaggacattgtcaccgggaagtatcagatcggggatctgatccctgctgagagtgaaatgatggcttattataaggtcagcagggctacggtcagaaaagcgatggatatgctggcagatgaaggactgatcgaaaaaaaacgcggccatgggacttatgtaaagaacatgaaagcaaaaagtgataaccagaagatcgtcaattttttgcgggaacacagtgacggcaagagggtggcgagcaaaaaggttctggataagacggtcattcgtgcggatcaggaagtcttagaaaatcttcagcttgaagagggcgcaaaagtgatcaggattgagagggtccggtatgcagatgaaaagcccatgtatattgagaccaattatctggattacgattgggttccggaagcgctggagaaagacttttccaaggaatcgctgagagtttattatgtgaaccactgtcacatcaagctggcgaaagcggaagaaaagatttattctattttggcagatgagcggaggtccaagctgcttcaggtggaagtgggagcgcctctgatctatgtgaagcgtgtttcctatgacgaaaacaaaattccaagagagtatgtagaagcttattaccgggcagatacttattatctgacagttgaattagcattataacaggagactgccgttttgccgcggcagtctgtttatttgggagagatgtatgaaaaaagcaatgatactccttgccggttatccggcaacggggaagacgttcttctgcaaacagattttaaatcggcacaatgaatttgttgtagtttctcaggatgaaatgaaagagaagctgtgggaccgttttggatttgaaaatatagaagaaaagattcgtctggaagatcaaagctgggagttgtactatgcaaagctggaggaactcatgagcggggagtactcggtaatttcggattatccgttcagcgaaaaacagaagggaagacttgaaagcctttccttaacttatggatatcaggtgctcacgatccgccttaccggaaacattgatgtgttgtatgagcggtcaagaaacagagatctggaaccgtccagacacctggcacatttggtgacacgatatcaagaaggggatgtgctggaagaccggacgaaggcggatgctctggtgacttatgaaatatttaaagaccggtgtttaaataaaggttatgataagtttcagctggggagtctgattgaactggacgtgacggattatgaaaaggttgattatgaggcggtgttagatcgggtggatgagatattggatcgatagagacagaattgtgaaaaaatttgtttttaatgtttaacggaagcaaaaatgtgatgaattaaatattttgaggatcgtaccagtattttctataaatttttaaaatatatggaaaaaggcaattattatagtatgatatttaataaaggtcggcctatgatagcgtataaagtatgggggatcgaccgatttaaaaaaatccgagtttatgcgggatggagagatatgtgagctttttggtgagaattgttgttttaatagaatgactattttatgcgaaggaaatgggtattagagctaactataagtgtttgaaatacaccaattgaacgcgtacaaatatagtcttagtgtacttaggattaacaataagtgatcaagataacatctggaaactgtgcagaatcagacagaagcggtattggaattatcatagatgatacaagctactcagatataagggatgtaaataagataattccatattaggcaaagagaaaatgatgaagtataaaaggaaagtttatatgtctatattataaggagtattatgataacaaaagaattagactgttttaacattgcacagatctgtgattccggtcagtgtttccgtatgaggcagaagcatgacaatacatattcggtgattgcaggaaatgaatatttggaagtgacccagaatggaaaccaatgcacatttcactgtgatgaaaggaagtacgagacattttggagggaatattttgatctgaatacagattacaaaaaatacatagaatcaattgatgaacaagaccaatatctgaaaaaagcctcggagtttggtttcggcatccgtattttgaatcaggatttatgggaaatgatcgtctcatttttaatatcacagcaaaacaatattgtccgcatccgccggtgtattgacaacatttgtgagtgttatggagagaaaagatttgacggatcagggaagctttactatacatttcctcaagcggaggcattggcggaacttcatgaggatgctttgaaggacagcaacctggggtaccggagcaagtatgtggtgcggactgcaaaaagcctgacagagggagaagtctctttggaggcaataaaacaaatgccttataaagaggcaaagactgaattgatgaaactgtatggcatcggggagaaagtggcggactgtatctgcctgtttgcacttcatcattttgaagcatttcctgtagacactcacatcagacaggctctggaaggccattatcctgacgggtttccggcagaaagatacaatggatgtgaaggagtcatgcagcagtacattttttattatgaactgatgggaaagaagatgaataaatgaaggagttgaaagttaagggatctgagatcacaatttttgatgataaaataaggaaagatgacccggtcatctggatacatacttttccgggagaagcagagaatatccgggcacagatgaaggaacagtgtattcttatcggcatcacaggtgccgactggaaccaggatttttcgccgtggcgtgcagatagggtattcgcatccggaggggattttgcaggggatgcaagggagatatctggacatttgggaaaggaaaaaagcacaagccaccgcgccgcccgcacagtaaaacagaataaccgacagcaaagagggattttccaaccacgggaaatccctttttcgcgcccggaaacccgacggtatcatcacgacgcagaggaacgggcagatcattgttgcggagttgttttcaaccacagcggcacagaaacattccgcgacaagctattgaaaatgatacttgccgacaggacggagtaaaacggaaaaccgcttatttgtaaaaatccattccatactccagaaatgaaaggagcatttcagatatgccaaagaccaaacttgaaaaaatcgcaggtatcgaggaggaaatcagacagcttgaaaacaagcggaaacagcttgtgcaggagcaaaaggcgcaggcgcgcaaagactggaggaaacatctttgccgccgccgcttatcgggcgggggaatgaccgccgccagcaggaggaacaggaagcggaggaaaagcggcttgcatacaaccgagaacggcaaaaggaatggagggagaaacacagagccagcgagccggagaagcaaaaaaaacattgtggaaatgtgcataacaggctattgtgtcatggataactctgttcacagaacatggaaaagctaaagtgcagctttcccatattttgcaaacagagttacccacaactccataagacagccagttatacacattacacacaatgccgacgactacggaatccctctcattcttatatggtcaaaaagatagataaatataaaactattttgaatttgaaactttatttttagaagttgaaagtagctgtttttcaagaatcgcctgttcttctccccacttttttaactcctgtaacgctggaaccaactttaatccggcttgtgttaaacaatactctacatgaggtgggatttccgaatattgaatacgagtaactaaaccatgtgtttccaattcttgtaatgaacgagttagcataatattggtgataccatgaacttgcctttttagttcattgtatcgtatatttccataagataatttccataaaattggtaacttccaacgaccactgagaagattgagcgcacttacaatttcacaagagccattatataaatttctatcagccatttattcctcactattctagggcacaaaagtgtgcgtacttgtatttttgtttcttaaagctatactaattataacaaaagttttttgaatgtaaataaaaagggagttttgtatgaaagtaacagcaattaacggaagtccaagaaaggattggaatacggtcgctctgttaaagaaatctcttgaaggagtcgcttctattggtgcagaaacagacttgattcatctttatgatttagattttaaaggttgttgtagctgttttgcgtgcaagaaaaaagaaagcaatcttaatggacattgtgcaatgaaagatgatttgacagaggtgttaaaaaaagttatatcaagtgatattttgatattcggttcccccatctatttaggcaacattaccggagaaatgaaatcttttatggaacggcttatatttgcaaatctttcttatgattcagcaaaccgcacaaattttatgggtacgatacaaactggttttatttatactatgggcttgccacatgaaatgataaaatcgtttggctatcattatatttttgaaaacaacaaaaattacttgaaacttttaaatggacattctgaatatatcatttctgcagactgttaccagtttgacgattattcaaaatatgctgcatcaaatttcaatgcagaacataagggaaaaatcagaaaaaagcagtttccgatagattgccaaaacgcttttaaaatgggtgaaaaattagcctcatatgcaagtaatcaaggcgtaacagcttaaagcgctgctatccttatgaattacagatgtaaccataaactatgcaccgccccacgtgggagaaaggaggaattttctatgacttgcacggcaatatcttgagaagtcctaaaaagccagcaaaatcaatgatttcatggagagaaaaggcgtttactacaccactactacaccatttttgaaagagccttgaatgacaaaatagcaaaagatgaatgaatttgataattttgtagaaatctaaaatatactggattatactgtgaattgggtagacatcgtctacccaatttgactaagaaaatgtatacttattgacttttgcgctttgtaattatataataacaagcataaaagtcaatgggaagtagaggattattgtgggagcaactgaagagattattaagatggcaaaagggaataatggaatagttactactgcaatggtggttgcagcagggttttcacgtgggaatattaaataccttgttgataagggaataatagagaaatcctcccgaggtatttacattttgccggaagtttgggatgatgaaatttttaatttacagaatcgatttaaaagaggagtttattcccacgaaacagcattgtttctatgggatttaacagatcgaacaccgaacaaatatcatatgacttttccgatgaattacaatttgacaaacccaaagaaagaaaatattaggtgtgtgcagtgtaagaaagagatatatgatttgggaatagaagaagtgactacaccgggtggaaatgctgtaagagcgtatagtgtagaacgaacgctctgtgatattttaaagcctcatagccatgtggacattcaggtggtaacagaagcttttaagcgttatgcagctaattcggataaaaatattcctgttttatctgaattagcaaaacttttaaaggttgaaataaaactcagatcatatctggaggtactgttgtgaaaaatgcaatgcagttaaaggcaattattaaaaatcttgcaaaagaaaaacatatatctgcacaactcataatgcaaaattttatcttgaagggtggatttttgattgcagcgatggttggtcttgacactagagcaaccatggatatggacgcaacaataaaaggattgcctgtaaatgaacagactattcgggaaatatttggagaagtatgtaaaatagaattgaatgatgatgtgttgtttagttttcggagtaaatactcggttacagattgatgatcaaattaaggacaagacagaacttacatatgcatcaacggtagtgggagaagcgcttcctagttctcataatggattgggatataagaatcttattaaaattaaatttatgttggcggattttgcggataagattaaacagggaaatcttgcatgtattcccttattgtttattgaggaaccggagtctcatatgcacccgcagatgcaacaaacatttgctggttatttagaaaagtacttgatgatacgtttcgtgactttttgagtgagcttgttggtgatgataatatttttacttatgaggaatatatcagccgtgattggagggccggataaattgattattaaaagaaagtataattaaatagcaatttaaagaatcattaccaaaaataactccccatgtgttccacatacattctatactaacatggtaaatacaggtatggatataaagaccttacagtatgtaatgggagattctgttgtgggagcgacgctgaatgtttacacccacgcaagctatgaccgagctgcggaacagatggcaaaagttatcggttttaaggtaactgctacacaggaaaaacaaagaaaatcaggttgacaatacaccagtttactacaccatttgcccatgaatttgcgtagacttatgtagatatgcatagagaaaggtaaaaacagaaaatcaagaaaacgccggaaagccagtaattacaggtatttgaaggcttatgaagggatataaaagatatgataaaagtactttttatttgccacggcagtatcttgaaaagtcttggagaagccagtaaaatcaatagttctgttacagataaaggcgcttactacaccactactacaccatttttgaaagtgtcttgatatgacagtaaaagcaagttaaaatataattattatggaaaattgaggtgacataatggaaaatcatttgacgccataccaatcagttattacagaaattaaaagcattatttcttccggacaagaagcagcttatagtgcctctagtaaggcaatgctgcttacttattggaatattggcaaacgaattgtagagcaggaaatgggcggcagtgaacgtgcagagtatggcagaggtttaatttctgcattggcagacgatttgacaaaggagtttggcaaaaattattccaaaaggaatttgcattattacatcaaattttatcagtgctttcccgatgaacagattgtgaacgcatgcgttcacaatcttaactggacgcacattcggagtcttcttcgcgttgcagatgaaaatgcgcgctattggtacatgaaagagactattgatgagaactggagttcaagaaccttagatcgtaatatcagtacgcaatattattatagactgcttcaggcacccaaaaaagatgctgtaattgaagaaatgaaacagaaaaccgcagagtttcagaaaaatcagtttgaactaatcaaaagtccggtgattgcggaatttcttggtttcaaaaatgaagatacctacttagagggagatttagaatctgccattctttcgcatattagagattttttaatggaattgggcagaggatttgcattcgtggctcgtcagcagcatattgtaacggaaacttcggactactatttagatctcgttttttacaatatcgaactgaagtgttatgttctaatcgatttgaagatgggcaggattacccatcaggatgtgggacagattgatatgtatgtgcgcatgtatgatgaattaaagcgaggaaaaggagacaatcctacgattggaatcttgttgtgttcagaaactgatgaggatattgccagatattcggttcttcatgataatgatagactttttatgtcaaaatatttgacttatttgcctacaaaggagcagttgaaagcagagattgagagacagaaagaaattttttctatgcagcatccagatatatatgtagacgaacagaaatcggatatgtagatacaaatagaggggagagaaatgattcgtgagtatatatacgaaagaagagtttgctaaattatcagtcatgtatgatggtgataaggatagagatgccacgagcaagattaggggattcttatttcaggattatattacgattatgtgtctccttcagaagcaagtaaagtatgtctgttcagaatatctagaggatgtggatgtatttttcgaggatggcacattcgagtttattcaggtgaaatattatccgaagacaaatccgaatatgaaggaaatttcgacagatctttattatcagtatctacgcctccagatgcttcagtctactttgacagcagttccgagactttatattcatagaaagtcaaaggttaagaaaccaacgtttgatgagatgaaaacatatattggacttgcatagttacaaactatggataagcatttccaaatagaattttatatgaatagaatgttgtgatatactaattggcatggagggaaaattcatgccaatttatattattaccagatttttgctgtattgtataatcaatgcgtttacaccaggacccggaaatattcttgcactgaatacagtaacaaattatggttggaaaaaaggaaaaccgctttttttagggatatttgcaggctattatattgttcaggctatttgtgcaatatttgtctttggcgtaagtagttttcttcctgatattttgaaaattctgaaatatgttggtgccgcctatattttgtggctggcctttcatattgctgccagtaagccaaatataagtggcgacagcaaatcagcgtctttcacaaaaggatttatgcttcaatttgtaaatatcaaaatatatatgtttggcattacttcgttgacaggctatattacagattacagcacatctcttagcattttgctattatttgaaatgataattgcaacgattgggacaatcgcaacaatcacatggattggattaggaatactaatacaaaaatattatcttaaatactatcgagttataaatattattcttgcattaacattattggaatgtgtatatagtatgctaaaataaattgttttctgacaaaatagcaaagccagtcgagccagtcaacggtcaagatgaacggcgcgtatgcgccgccgttgacagccccgcccgtctttgcaggagggtaatcaaggcgctgatcagttttgctattgtcataatctaatctatttccaccgctcagaaaaagccttgtttctccacagggctattccggtcatgggtatgtattataccatgtaattcaacgaacacagcaaagcatttttttcgcccggtaggtttgcgacctgccgggcgatttttattatgggtcgtgaccctgttgagcacgcaaagcgtgcgaaatagaaaccacccgctatgcgggtgcgcggtgatagttatacaaaaaaatcacctttccgttataatgaggttgttcaagccaatatataacgaaaggaaaggtgattttaatggccaataaggcaaacagtttatcacataccaaatggatgtgtaagtaccacatagtatttacaccaaagtaccggagaaaaatcatatacaaccagtacaaagagagtatcagagatattctgaaacagctatgctcgtacaaaggcgtagaaatattggaagggcatctgatgccagaccatgtgcatatgctcgtaagtattccgcccaagctgagtgtatcacaatttatgggatatctcaaagggaaaagcgcgctaatgatttttgataagcatgcaaatttaaaatataaatttgggaatcgacatttctgggcagaaggatattatgtaagcacggtaggattaaatgaggcaaccataaaaaaatatattcaagagcaagaaagtcatgatatagcaaaagataagttaagtgtaaaggaatatgaggacccttttaagggtggcaggtaatacaaaagccctttcaagggcagcgacgagtcaagggcgttaaggcttgaacaaagtgaaagccagcgtctttaggcgctggccggtaacagaggcttatagcctcagaacaagccgcccgttttacgggcggtcatgactaccattcctactacttcccatagcaaagatgtgaggggttatgagcggaaacgtgaacatcttccgacatataagaacttctaaagagataatcgaaaatctatcaaactattaatatgaaccttagacagaaaattatatcaaaagtctctctatgatttttaacgtagagaggcttttttattttttcttaagaaagaccttgtcacgctaacgcgtgaaagactttcctaaaaaataaaagaagctatccaacgatagtgatataaaactcatatataattatgcacaataaattgacagaaatgatatataaattatacaaaatagcaagaaatgattgactgatataccgatataccggtatactaatcgtatcaaaagtacaggttcattttagttttttaaagagaaggaggtaactgtaatgtatttatttttatcacacaaattagatccggaaggattggcgtggccgggggagccggttattaaggtggagcagatgaccgatgtatcagatgactgtccattttgttcctttataagcacattgcccaatcatttcggaacccatatggatgctccaagacactttgttaaaaacggaatcagtatcaatgaactgccggtagaatatttctttcacaagaaaaccgcacttttagaaataccaaagagcgatgcccagggaatcgccaaagaggatctggaaccttttgcggatgttttatcacaagtatcttttgccctgatccgtacaggatttgaacagtataagtttacagagccggagagataccaaaaggaagggccatatatcgcgccaagtgcaggaatttacctttcagaaaattttccggacttaaaaggaatcggaatggattttctggccatcggatcgccgtctgataaagtgccggaaggagaacttcctccggattgccacagaaatatcttgggattctatacaggaaaatttgtgacaggaatagaagacatgcatctctcagaaattccaaaggatgcaaaaatacttaattttatcaatgcgccactgaggattgaaggtctggattctagtcaggttgtatgtatggcagagattgaagagaaatgacaggagacagaaaaatgacaaaagtaggatttataggtcttgggatcatgggactcccaatggccattaatttaaaaaatgcagacgtagagctgatggtaaatgatctaaatcatcaggcagtaaaacagatgacagaccttggagctttggaaggaacaaaggcacagattggaaaggaatgcggcattatttttatgatccttccagatggaatgattgtaaaggactctcttttcgggaaagaggggatcgcatccacggtcagggaaggaacggtcatatgtgatatgagttctgtgacccctgtccagtcgaaagaatgttatgaagaattggaaaaactgggagtcagttttgtggatgcgcctgtcagcggcggggaaccaggagctgtttcaggaactcttgccatcatggcgggaggcgatcaggacgcttttgaccgactgattccgtattttgagattatgggatcttcggcacttctgatcggcggaagcggaagcggcagcattacaaagcttgccaatcaggtgattgtaaatatgaatattgctgccgtttcggaagcttttgtccttgcatcaaaggccggcgcagatccgtccaaagtttataaggcgatcagaggcggactggccggaagtgctgtcttagatgcaaagatgccgatgattcttgaaagaaattttaagccgggagggaagatttctattaatcacaaggatattaaaaacgtggttgagacagcccatgaaatcgacgtgccggtgccttttaccagccagctttttgaggtttttcaggcactgaaggtatcgggacatatgaatgacgatcatgcagggattgtccagtattttgagaaacttgcacagacagaagtaaaaagtacaacagagaatactgagaggtgatggattatggctgaatatatgacgatagaagttttaaagcagtacagtcctgttgacgaaagaaagatcggccggctgctgaacgaagagattaataaaagtcagataaagtttgttgttttggatgatgaccctaccgggatacagactgttcatgatatttcggtatttacagactggtcaaaagccagtatgagaaaagggtttatcgaagaaaacagactgttttacatattaaccaattccaggtccatgacaccgaaacagacaagacaggtgcatgaagaaattgcccggacagtggaagaaatctcccgggaattgaatcagaaatatgtgttgatcagcaggagtgattctacactaagggggcattatcctttagagacaaatactttaaagcaagtcatggaaaaacagggcgatcatcctgttgacggggaaattctgtgtttcttttttaaagaaggcggaagatacaccattgataacgtccattatgtaaaagataatgaaatgctggtaccggccggagagacggaattttccaaagataaaacattcggatacaagagttcagatctgagagagtatgtggaagaaaaaaatgaaggggtgtttaagggagaagataccatctgtatttctcttgaaatgctcagaagctgtgactatgcacaaatcgagcaaaagctgatgactgttgaaaatttcaataaggtgattgtcaatgcagtggattattgtgaccttaaagtattctgtactgcgctctaccggacaatggagaaaggaaagacatttttattccggtcggccgcatccctggtaaaggtaatcggaggggtaacagacagggaacttttgactaaaaatgaaatgataactgcggacacaaacaatgggggaattgtggtggtaggctctcataccaataagacaacagcccagttaaaggaacttctgacattagacaaagtaactggaattgagtttaattcagatctggtactgaagggagatcaggtttttgaggatgagatcagccgggtggtaagtcttagcgaacagatcatagcatccgggaagactgccgtatgttatacaaaacgcagactgctgacagttgacaatgacagcaaaacggaagctctgctccggtctgtaaaaatttcacagggggttcaggctctggtgggaagactgaaaattgttcctgcctttgtagttgctaaaggaggtattacatccagtgatataggtacaaaagcactttcagtgaaaaaagcaaatgttatgggccagatcaaaccgggaattcctgtctggcagacagatgaacaaagtaaatttccgaaaatcccatatattatttttccgggtaatgtaggagagacttatacgctgaaagaggctgttgaggaattgatccgcagataaaacggcggttcaggaaggagtggcagatggaacatatgaatctgtatcttgcagaactggttggaactgcattatttatggtgttaggattgggtgtctgtgcaaatatttctttgagtaaatccggtatgtgcggagccggaggtattgtagcagctcttggatggggtgtttcaatggtgacggtagcagtatgtttcggacctgtatccggagcgcactgcaatccggcagtgacggtgggtttttgggcagcaggaaatttgagcggaagccttgttccgggatatatcatctcacaatgcataggggcatctatcggagctttgatcatctggcagctgtataaagatcatctggatgaagaagagtgtccgggtaccaaactgggtgtatttaccacaggtccgtcaattcagaattcctggcggaattgtctgtcggagatcatggcaaccttttgtctcatgtttgtcctgctttccctcggacatcaaaatccggcaaatggagtgtcaatgttctttgtattctgcggagtagcaggaggggtcatgtcttttgggggactgaccggttatgccattaacccggcaagagatcttatgccccgtattatctatacacttgtccctataaagaataaagaaggatcaaactggggatatgcgtgggttcccatagcaggtcctttgatcggagcatttcttgcggcaatgctccatcgagtgatcttttagtaatctgtaaatttacggacatcctttttttcaaatgtattggagaaaaggatgttttttcttctataataaattgcagtggatgaaagaatctgaaagatatgctatagtattagataattgttaacaatatgatgaggctttttagaagatgaggtagtagcatgaaaagtacacagctgttgcagtccaaagcatatgattatctgaaggatctgatactgaacgataagttggaacatggggttatctattcccagaaaaaagtggcggaagaactgggaatctcaaaaactcctttgagggatgctgtcttacggctggagcaggaacgctatattgacgtctatccaagcaaaggattcatgattcatgaaatgatggaggatgatatcagggaaacctatcaaatacggaatgccattgagaccttttgtttaaaacagctggtcgcagatttggattcagccgaggcacaaaaatgtctgatcgatctgagaatgaagattaaacagcagcagaatttgatcgatacaaacggttccagtgaggagtttgccaggattgattatgagtttcataaaggtatcgtggagtttctggaaaatgatgcaatgctgcatttgtataaagaatatatgcaccgtatcttttggcagaatgttctttcttttacacgggaaggaaggatgcaggagaccatcggggaacacaaagggatcatggctgcccttgaacagcagaatcatatagagcttgaggacctgctgaaccgtcacttatcagtggcagaaaatattaatctggaactgataaaggaaaaaccaaagatgctgtagtaggatataaacttagataagatttagcacatagaggagatgagctattctgatttgggagagcttgagacacaacttgagatttatactaaattaatatataggcgagaatggattaaaaaatatgctatacgataaagacattcgcagtcctctctttgattttttggaggagtgctatcataagatcagaataatagaagaaaaacagatgggacgatccagagcagatattgtcatggttacagaggattctgtttttggtatagagattaagagcgatgcggatacttatacccggctgagcagacaggtcagagactatgaccggtttttcgactataattatgtggtcgcaggcaccagacatgcactgcatatagaagaaaaggtaccggaatggtggggaatcattacggtagaagaggcaggagatcaagtggatttctatctgctccggagtccggtcaaaaatccgaaactcgtgtggaaagataaaatgaaattactttggaggccggaattggctcatatacaggaattaaatcagcttccgaagtacaaacaaaagagcaagagattcgttattgataaaatcatagagagggttcctcaggatatattgaagacccaaatcagtgatgaattgtttgagcgggactatcacgcaatcgaagatactatccgcctatataaatctggggaaatttgacagggttaaaaggacttgcatattatttttttcaggattataatgacttcaatgtatcatcagcagtccagaaattaatagcggataatttggtctctttatgttttcggacataaggagactttttagtctattatgaaagttatgaaaaatctcggcggaataaaaaaataccctgtgagactgcataaaaatcagaaaggaagtataacatatgagttactacagtgtaaatttacccagatatacaattggagaaggctgttatcaggaaattccggagaaggcccggtttcttggaaagacagcagttgtcatcggaggaaagacggcaatgtcaaaagcaaaagagaagcttttggagggggtgaaggattctgacgtgcagattttggactttatctggtacggcggagattctacatacgaaaacggaaatgttctgatgaagcaggatgtggtgaggcaggcagatatgatttttgccgttggaggagggcgtgcctgtgatacaggtaaatatctggctaatgaactggacaaaccgctgttttgttttcctacggttgcatccaactgtgcggcagtgacagcgatttcagtgatctatcatccggatggttcttttcgcgaatactactatcccaaagcagcggaccatacatttattgaatcatacagccccgttgattgactatgggaaaaaggcgctggaagatttaagggagaaaagagtctcctatgaattggaacaggtgactctggatatcatcatcagtacaggacttgtttccaatatggtcagcagtgcgcctgattattactataattcaagcctggcacattgcgtatattatgggtcaacggtcacgaaaggaggacaccgtcatcttcatggggaggtagtagccttaggagttctgtgtctgctcacatttgcgacagagtttgaagaacgtgataaaattgcaaaattcaatctgagtatgggacttccggtctgttttgatgatatcgaagtgtctgagcacgaatttgatgtaatggccgataaggctcttacaacgacagaatgggagttccgtccaaagaaaagcggagtgacgaaagaaagttttattcagtgcatgaaagaaacaaatttttacggaagagaattgaaagaaagtcttatatcataagcttatcgcgcagagtgcgcttaactgaaataaattatctctgtaaaacttaggagtaaagaaaatgattgagatgaatcaagatgagtttgatgctctgacagaatacattcagaatagatatgggatgaagctttccaacaaaagaaatttgattcaatgcagaattcagcatgagctggagcggctgcagctggagagttttttggagtatgtaaaagcagtacagaaagatccggagacagaacagaatttaattgatcttacggccaccaattatacatatttcatgagagaaagcgggcagtttgagtatcttgagcatgaaatattacagagattaagaggtaaagaaaacgtatttcgcatatggagtgcaggctgtgccaccggtgaggaatgctacactattgccatcacggcggaggaatgccgaagacggggatggaaacttcccaaaatcgagattaccgggacagatattgcaaaacacgaactcacccagggtgaggaaggaaaatatctgcccaggcagcttataaaagttccggtggactggaagatgagatattttaagaaggatggaactgcctatgcagtcattcagctgatcaaggatatggtgcggttccgttatcacaacctggcagagcagcagtggccggatgagcagtatgatgtgattttctgccgaaatgtgatggtgtatatggacattcagaagaaaaaagaaattttgcagggtctgtaccagtctttaaaaccgggaggatatttatttctcgggaatggagaaattatcaggccggggcatgggaagtgggagtttttaggacattctgtttatcaaaagaagtaacacggacagtctcagggtttttaacctggggctgtttttcgtttttctgataaaataaaaacaattcatcagggacatacacaaagttatcaagcccctatattgtgtccatcgtatttgctataataggactgacagctaaataagaatatagaaatgagtttatagatgatgaagagattagtaatcggaattttagcccatgtggatgcaggaaagacaaccctgtcggaaggtctgctctatgagagcggcagcatccggagcatgggacgggttgataataaagatgcgttcctggatacacatgagattgagagaaaccgcgggattaccatattttcaaagcaggcagttctccggttcggagaaatggaaatcacactcctggatacgccggggcatgtggatttttctgccgagatggaacggactctgcaggttcttgattatgcggttcttgtgatcagcggcgccgacggagtccagggacacacgcaaacgttgtggcgcttattggagaaatacaaaattccaacctttttatttattaataagatggatcagccggggactgacaaagaacagcttttgacagaattaaaaaatcggctggatgagggatgtgttgatttcagccgggaatgcggtgaggatttttatgaagatatcgcagtttgtgacgaaggactgctcaactcatacttagacagcggaatgatcggcagtgaagatatttcagaaatcattgcggagagaagggtatttccctgctatttcgggtccgcattgaaagcagacggagtccgggaatttttgcagggaatcgggacttatacccgtccggtggattattccgaagaattcggggcaaaggtgttcaaaatctccagggatgaacagggcagccgcctgactcatttaaaggtcacaggaggtgttctgaaagtaaggtcggcgctgatacaaaaaccgaaagaggaaaaggtcaatcagatcagaatttattccggagaaaaatatcagacggcggaggaagcacaggcaggaatgatctgtgtggtcacagggcttacggacacccgtccgggagatgggtttggtaccgaggataccggatatgagccggctctggaaccggtgcttacctatcaggtcatactgccggaagggatgagtgcaggagtgatgctgccaaaattaaggcagcttcaggaggaagagcccgagcttcatattttatggaatgagcagcttcaggagattcaggtgcagatcatgggagaagttcagctggaaatactaaaaagcctgattgccgaacggtttgatgcagaagttgaattcggaacaggaaatattgtttacaaagagaccatcaaaaaaacagtggagggcgtgggacattttgaacctctgagacattatgcggaagtacatcttttaatggagcctttggagccgggaagcggccttcagtttgatactcagtgcagcgaggatatgctggataagaattggcagcggctgattttaactcatttgcaggaaaaggagcatcccggggttctcaccggctctgcaataactgatatgaaaattacgctggcagcagggagggctcatttgaagcataccgagggcggtgatttccggcaggctacttaccgggcggtgcggcagggtctgaaacaggcggagtctgtccttttggagccgtactatgagttccgtatggaagtgcctcagcagatggtgggacgggctatgtcggatattgagcggatgtacggggagtttgaaaaccctcagacagagggagagatgtcagttctgaccggaagtgccccggtctcagagatgagcggctatcagaaagaagtcatagcctacacgaaggggaggggacgtcttttttgtgcccttaatggttataggccctgttacaatgcagaggaagtgatcgaaaagagcggctacgattctgagcgggatacagaaaatccgacgggctctgtcttctgttcacatggggcaggatttacggtgagctgggacaaagtcaaggactatatgcatgtggaatgccagcttgcggcagaggaaaaagagccggaagaagaggacgcggtgcgccgttcctatacggaagaggaatggattgacacggaggagatcgaccggattctggaacagacttattttgcgaaccgaaagaaaaagaccggatgggtcaaaaagaaactggagaggacgatggaagattataagagttcggcttccagggcctcagtgaagaaaaagccgggtgaaaaatatctgctggtggacggctataatattatctttgcatgggaagatttaagagaactggcagaggtaaatattgatgcggccagagggaagctgctggacatcatgagcaattatcagggcatcaggaaatgccagctgatcgttgtttttgatgcctatcgggttgtgggtcatgatacggaaatattggattaccagaacattcatgtggtctatacaaaagaggcggagactgcggatcagtatatcgagaagttcgcgcacgaacatgggcggaaatatgatgttacggtggcaacctccgacggcatggaacagatcattatacggggacagggatgtgcactgctctctgccagggaactgcttgaggaagtgaagcttgctgaccggacaatcagggaagagtttttggaaaggcagcagaaggaccgcagttatttgctggattccatgtccaaggaggagcggaaaaagatcagagatttagaataagccaaaagtaaggaggagaacaaatgcagctgggaattacgattccgttacaaaagcatctgaaggtgaaacagccgccgtatggggagcccatcgactcacgggcggaagcctgtggcggggcttaataaggcaatagaatgcatggaatatacagatgagccttggaacatggataagatgtatcaggagcacatatgccgctgggtgaaccgcgatatttgctcgccggccggttttgagacgtatgatcatccgtgtgcattattagaggaagatatgaaacgggttggaattgttaggaaaggcacaggacattgatgcttgggagacaggataaggcaggaattgtatgctgttccaacggacttgcagactcggcccggtctgccgtgatgatgctgggaaatgccttggagcagctggggttcatacccgttttcagccggtatctttatgccggttcctcagtatttgacagaacagggaggcagcgtgccggggaacttatggagttttaccggaatcccgagatcaaggcactttttgatatttcgggaggagatctggccaatgaagttctgacgcatttagactttcaagtcataagggaacatttacaacaatggaggcctggggatgtctcccgaggatggaagagcttgtgaagaagatgtccggtccgggagtttccattgcaaagacggaggaaatcggccatgggacagattcaagtgcacagtgggatgatatttttgatcaggcagaaaaacttggcataagttttatattgctggccggaggggaacctttgatgcgcagggatgtggtagaatttgcgggcagacataaaaaggtaatctttccggtgtttacgaacgggactatgatgcaggaagattgtcttaaattgttttcggacaacagaaatctttttccggtgctgagtgtagaaggcggcgaggaacagacggatgccagaaggggcagcggagtctatcaaaagctcagacaggtcatgggaagtttaaaaaaacggaaccttttattcggcgcatcggttacggtgacaagggaaaatctttttgaggtcacgtcggaagaattcctcggtgaacttggaagaaacggctgtaaggcagtcgtctatgtggaatatgtacctgctgacgggaagacagagtatttagctccgggtgaagaagagagagaagcgttgggaaaaaggctccgaaagctcagagaggaccaggaggatatggtgttcatatcatttccgggagatgaaaaggcttcaggaggatgtctggcggccggcaggggatttttccatatcaatgcatccggcggcgcagagccctgtccgttttctccctattcagatacaagtttggtacatacaagccttaaagaggcattgcagtctcctctgtttttgagactgcaggaaagcggaagccttgaggaatttcatactggaggctgtgccctgtttgaacaggaacagctggtaaaagatttattacagggagaaggataatgaatacaaaagaacgaattgtggaagaagcgctcacgttattttctgaatatggatatcaggggaccagtgtgaaaaacattgcggatgccgtaggcataaaagacagttccttatacaagcatttcaaaagcaagaaggaaatatttgatacgatcgttaaggagatgtcggttcggatggaacggatgtcaaaggagtacggcctgcccgatgaacacgatatggaaaaagccgcagagctttatggaagtatcagtgaggaagggattcttgcgctcagcgaaaagatcttcctgttttatctgaaagacgaatttgcgtctaagttccgcaggatgctcgtgattgagcagtaccgggacagagaggtgtttgaagtgtaccggggactttttatggatgcggctgtgtcctatcagacagaattgtttgcggagatgactgccaggggcgttttccatggcaaagacccaaaagccatggcagttaacttttatgccccgatctttttcctgctgaaccggtatgatcagcaaccggacaaggaaaaagaggcactggaagcattgagaaaacaggtaatggaattttcgaggctgtataaatagacagagcttatactgtgaaagaaagtagaggacagccaataaaaggcgcactttaataagctgtctaatggcagcgcaaaaaagattattgttttaaaaagctaagaagctaattgcgattcggaaattttcccttcgcgtataagaagtttcatagcctgcttgattgccttttccttttgtttttctttcataggttctggcatatcaattttaaataaatcggtcggattccatgtttccccagtagataacatctgatagatagcagtgagaatcatccgggcgatagcaataatggcacgttttttaccacgacgtttcatgatgcgttcatacttttgcttgtagtaaggagatttatcagatttcacggctgcatgggcaacttgtaccaatgcaggtttgaggtagacaccggcacgtgttatcctgacagatttcttcttaccagcagattcattgttgccgggagtgagtcccgcccaacagcataaacgtttggaattcgaaaacggagtcatatcggtaccaatttcagagataacagtgattgcactgttacgatcaacacctggaatggtacacagtaactggacagcattttcatatggagcaatcaaagaatcaagcatcgtgtctatatcatttatcgtagatgtgatataatccagatgtgcgcggatgaggcgcatacgatatttttgggaatcagtcatctgatagccttcgatggattcaatgacactgtcagacttcttctttagggaacgaagcagtctggaagctatttcttcgtggttgatggaattgtcaggttgttcaattaggtaatcaataacagatgtagctgatttcccgaagatatcggaaactactgaatctaatgcgacattacagacagtgagcgcattctgatatctgttcttttcactggtacggcaggaagtcagtttgtaacggtatcttgtaaattcacgcagaatacgaatcggcttacaagggatataacttcccggaaccagacctaatcgaaacaaatccccaatccatttggaatctttcgtatcatctttattgcctttgacagcttttacccatttagggttagcgatggtgacgtttatttcgtcttctaaaaggttaaagacgggaatccagtattttccggtagattccatacagacatcgcgacattggtttttaacaagccattctttgaattgcagaatagaattgttaaaggtggagaaacgcttcttttgatacgaaggttccacaccggaagtggttttaatgattgtggcaacgagaaaagatttgtgaacatcgacaccacaacaggtttgataaacaactttcataatcaagaactcctttcaaaataagataaagaagccattgactgttccaccacacatttaacagagaagttaaaacaattcttactgtacggtcttatagagccccttatttgtgcttgaaagatggaacttacactgattattatgctgtctaaaacgaagaaagtctttacgacttacctcaccgtgctttgtagtatagcttctttaaaaactattttatcagcaatgtggaaaagtgaaagactttcattactatttgtgccgccgacttggcggcggaatggagattattatgaaagggggaaacatgaaattaataattcacgatctgaacgaagaagaagtcaaaaatttattttctgaaccggatgaagatgtggtcctgataggaaataaaggggaaatccgtaattgtatcggctgtttcggatgctggatcaggactccgggcaaatgtattataagagaccggtatggtgacatgggagagctgcttgcccggtgtgaggaggctgagattatcagccggtgctgttacggaggctacagtccttttgtgaaaaatgtgctggaccggagtatcccttatctgcatccgtattttgagattaagaatggcgaaatgcaccacaggcagagatacgagaaaatattaaaattaaaagtgggattttacggagagtgtatatcagaagatgagaagtggaccgcagaggagcttgttaaggccaacgcagtcaatttgtatgcacaggtggaaggaatacggtttgtgaaaacaccggatgagttaggaggaaggtaacatgaagatcgtatgtatcaacggaagtcccaagccttctggaagcagttccggagtgattttaaaggaattaaaaaacttgctgaaggggctggatatcaaagagatctccgtgcgaaagccggaattaactgaagaaatgaaagcagcagtcatggacagtgagtgtcttgtgtttgcgtttcctctttatgtggacagtataccttctcatctgacggctgtgctgcggcaaatggaaaaattatttcaggaaactgaggctgacaggatggtctatgcgattgtaaactgtggattttacgaaggatatcaaaatcatattgccctaaacattatgaagtgctggtgtaagaaagcaggtctctcatggggacagggccttggcatcggcggtggaggaatgatccccatgctttctgatataccggaaggaaaaggaatcaagaaagatttctccgctgcgctgaaagagatggcgtgcagtatcagcaccgggcggaaagccgaagaccggtttgtttctccggggataccgagaatcatgtataagctggctggccagatgggatggagaaaacagatcaaagaaaatggactttcagtaaaggaactgtccagaaggattttaaaataagtattttacgggggactggatcatgagaagaaaagacagggaaatcacagatcctgcaaagatcagggcaattatttcggcgtgcagctgctgcaggctgggatttgcggatggagaaagcgtctatatcgtgcctttaagttttggatactgtgaggatggcgaaaagaggactttttatttccacagtgcaggtgagggcagaaaaattgaattgatctccaaaaatccctgtgcagggtttgaactggatacaaattataagctgaatgagagtacaaaagcctgcggctattccgcccggtttcagagtgttgtaggaagcggaaatgtatcatttgtggaagatacgaatgaaaaaagaaaggcacttttggctattatgtatcaaaacaccgggaaagaagagtgggagttttcagaggaaatgtttgacgcagtgtgtacttttaagctggaagtaagtgagatgtcctgtaaggagcattcctaaaaccaaaaatgtaaaatatttctaaaaaattaaagaagggtataccacacccggggaaattgttatataatagcagtattcatgaaaaccagatgttgatggagaaggtatatggacactttagaatatttaacaaaagaggtacaaaagttttgtgaggacagagactgggatcagtttcacgggccaaaggatctggccatcgggttgtcaaccgagtccaatgagcttctggatctgttccggttcaaatcagaggagcagatgggggagatgatggatcgggatacagcacgggaacgcatatcggaagaacttgcggatgtgtttttcttccttctccgcttttctcagatgtatgaatttgatttgaaagattctctccttgctaaaattgaaaaaaacggagagaagtatcccgtggataaagtaaaaggaaagaatttaaagtatacggagttaaaaacgactacagaatgaaaggttacatatggaggatgcacgcggattactgaaacaatatttcggatttgatgacttccgggaaggccagaagcctttaatcgacgcggtcttagaggggcgggatgttcttgggatcatgcccacgggcgccgggaagtctctctgctttcagatccctgccctgatgatgcccgggattacgctggttgtttcacctttgatctctctgatgaaggatcaggtgggagcattgaatcaggccgggatacatgcagcttttctgaacagttcattgagcatgggacagtatagaaaagccctggatctggcacgggaaggcaggtataagatcatatacgtggctccggagcggctggagacagagggatttttacggtttgctctttcgcccggcgtggatatttcttttttggctgtggatgaagcacactgtgtatctcagtggggacaggatttccgtcccagctatttaaagattctctcctttttggagaagctgccgaggcgtccggttttaggggcgtatacggctacggccactgtggaggtaaaagaggatgtcctggatatcctaaatctgagagacccgctggtcgtgacaacaggatttgaccgggcaaatctgttctttggagttaagaagcccagagataaataccgggaattagaatcctatttaagagagaaagaagaaaaaatgccgggaagcagcggcattgtgtactgcctttccagaaaaagtgtggaagaagtatgttatcagctcagagaagcaggattttcggtgaccagataccatgcgggactgtcggatacagaacggcgtgagaatcaggatgactttatttatgaccggagacagatcatggtggcaaccaatgcgttcggcatgggtattgataaaccggatgtgcgttttgtcattcattataatatgccgaagaatatggaaagctattatcaggaagccggaagggcaggacgagacggggagcctgcagaatgtatcctgtattttggagccgccgatcagaggaccaatcgttttttgattgaacatggagaggataatcaggaactggatgaggagacccgcaggatcgtgatgggaaaggatctggaacggctgaaacagatgactttttactgtgcgtccagcggctgtctgcggcattatatccttgattatttcggagaagacagcggcacggaatgccagaactgcagcaattgtttagaagagtttgacctttcggatgtgacagaacaggcagcggcggttgtcagatgtatcgaaagctgtcatagaaatttcggaatcaatctgattgtggatgtcctgagaggggcagacaatcaaaagattcgtcagaggggcctggaggataacccggaatataaggcattggccggaatgacagttccgagtctgaaacagctgatgaatgagatgatgatgcagggatttctgaatctgagcaatgacgactatccggtattggaactgacagaccggtccgaagaacttttgagcggtgaaaaacttgtcataaaagttccgaagagagaagaaaaacaggcgccgaaagccaggaaaaagaaggccggagccgcttctgctctggaagaaaaagatctgggtctgttcgaggaactcagaaagcttcgtatggagatcgcaaaggaggagaagataccgccgtatatggtattttcggataagacgctggcaggcatgagtgaggcaaggccgcagactctggatgagatgcttaatataagcggagtgggacagtttaagcttgaaaaatacggggagaagtttcttgagagtattaaaaagtatgaagaataagaaagacagagaactgaaggaggagatgaaatggctgtcagaaagatccgtaccggaaatgatccgatattaaagaagaagtgtaagacggtgcctgaggtggatgacaaggcaaggcagcagcttgaagatctcatggatactctgcacagtgcagagaacggggcggcactggctgcgaaccaggccggtattctcaggagaatgatcgtcattgactatgaagggtattatttaaaactggtaaatcctataatcgttgagagcagcgggtcacaggagtgtgtggaaggctgtttgagttttccaaaccgtttcggtaaaactattcgcccggccaaagtgacggtagaagcgctggatgaacacggacatgaagtatcttatacggtggaaggtgagatggcaaagtgtttctgccatgagatcgatcatttggatggagaagtattcatagataaagtatatgaatacgtaggaatcgatgagtaaagaaaaggtcctcgtattgttcggtgactctctcaccgactactttcctatggaattgtttcaagatgtggaggcgcaggtttataacagaggtgaagagggcaatacagtgccggagatggctgccagggcagagatggatgtggtttcgctgaaaccggatttagttctaatgcagggcggggccaatgattatctgcttcctttttaccggggcgcagaggtggtagccggtcagctgttgaggacggcagagcggattttggagaaacttccggggacaaggatttgtatcgaatcactgtaccctatgtatacaaaaaagacaggaaatgcgcttcctttctggtcagaagggaagtcaaacgaagagatacaggctgttaattcagaaattgagagactttgcggggaaaaagaaattccatatgtggatgtttaccgggaattgatcggggaggatggagaactgccgctttcttatacggtggatggtgttcatctcagcagagagggatatgaacaggtgtggaaggtattgtcccaagtgttgatagcggaaaaattcctgagatagaattgtggataaaatgtgcctgagacggaaaaggagaaaaatatgggagaaaaaaggctttcagacagtgcggcagaggaaattcttgcaatgatcacggttgagaaacggtttttgcccggtgataaactgcccaatgaaaatgaactctcacaggagatggagatcagcaggacgacgctgcgggaagcggtccgggccttggtcgccaacggtattctggagattcaaaggggccgggggacatttgtgaaacaggatattgacacggatgatgtgaagctgctcacgcctctgaaagatgttaaggtaaatgtaagggaactctatgagatgaggctgatctttgaaccggaggctgcctactatgcggcgcttagggcaagtgataaagaacttgaccgtattctcgcatttggacgccgggtggaagagaaggtccgcagggaggaagaccggacaaaagatgagcagatgttccacaggtccattgcaaaggcaacccacaatgaatttatgaatcagctgatgcctgtgatctatcaggggatcggagagggagtcacgctgtccagacagaaagagatggcggtacaggataccttaaaggatcatcagctgatcatggagtttctggaagccagaaatgcggagggggccaggagcgctatgagaattcatatcctgcatgctatgaaggaattaaatatagaaaatttgtagtttgaatttatacaggcaaaagaaacggcaggtgatgatctgcctacatgtactttaaagacagtagctgagaatatcaaaggaaaagaaatcagggataagacagttatccggccggcagaggagccttacagcaggaccggcggaattgctgtgctgaagggaaatctggcgccggaaggatgtgtggtgaaacggtctgcggtggcagaagagatgctcagccacagaggaagggcaagagtctttgacggtgaggaagcagccctcgaagcaatctatgccggcaggatcgaatccggagatgtggtggtcatccgttatgagggcccaaaagggggaccgggcatgtgggagatgctgaatcctacatctgccatcatgggcagcggtctgggagacagcgtggcactgatcacggacggcagattctcaggcgccacaagaggagcggccatcggccatgtttcgccggaggcggccgtaggaggacccatcgccctggtggaagacggggaccttattgaaattaatatccccgatcataaaatccggctgctggtggatgaaaatgagatcaaaaacagaaaaagcaggtggatgccaagacagcagaaattaaaaaacggatacctgaaaaggtatgccaggagtgtcacatcaggcagcacaggtgccattttagagtgatgatatgtgtaaaataaaaagatgacagaggatgaagtgattgaacagtgcgccggggcagatatattcattgtacagtatgaaagcgctgccggagcttaaatatgtcgtgagatagcaattcattgtcatgtggatatataaaatgggaccgaacgtttgatgcgtgcggccccattgttttagatttcaaaggtttccaatccctcaaactgcattttgtaatattttgcgtacattccgtcctgttttaacagctctctgtgggaaccgcgttcctggatggtatggtcatctatgacgaggatctcatcggcatgtttaatcgtagaaagccggtgggcgatggtgatcgtcgtcctgtttttggacagctcttccagacttttttgaatgtggcgttcactttcattatctaatgcacttgttgcctcatcgagaatcaggattggaggattctttaaaaacacacgggcaatagagatccgctgtttctgcccgccggaaagccgggtaccccgctctcccacaaaggtgtcataaccgtcggggagttccgcaataaagccgtggatgttagcttttttggctgcctcgatgatctcctccatagaggcctccggttttccgtatgcaatattatcccggacggtccctccgaacaggtaaacgtcctgctggacgatgccgatggaatttctcaggctctgaagagtcattcttcgtatatcctggcctccgatggaaacggtgccgccgcttacgttataaaaccttgggagaagggaacagatcgtagtttttcctcctccggacggtcccaccagggccacggactttcccgactcaatctcaaatgaaacatggtccagaaccacttcgttgtcttcatagccaaagctgacatccttataggcgatattgccgtccggatcggcgataggttctgcgcccggcagatcgacgatctcaggctctgtctcaataatatccagaaaacaccggaaaccggacagtcctttctgcatcatttcagtgagctctacgaggatctggatcgggctgataaaaataccgatgtacagggcatacattgccagatctccgggagtcatctgaccggcggcgatgaagcagcctcccgccacgagagttaccagatacatgataccctgaaagaacgtattgccgccctggaaggttcccatggctttgtagttatcccgcttggacatgaggaagccttcattcccctgatgaaacttttcccgttcaatatcttcattggcaaaggactgtacgatcctgatgccggccagagaatcctgaagggttgcgttgatgttaccgatctttttccggttatccaggaaggtggcctgcatccgtttattctggcgggccgaaaagaggatcatcatcagcactaccgcagacaggatcaatgccagtttccactggatgataaaaagaaaaataaacgatccgatgatctttaccacggagatgaacaggttttccggaccgtggtgcgcaaattcggaaatatcaaataagtcggacactaagcggctcatcatctgtcctgtgttgttctggtcataataggaaaatgagagattttcatagtgttcaaacagttccctgcgcatatccctttccatctgggcacccatgatatgcccctggcagcttacataatacttgcataatgcctggaggatatagaagatcagcagaattcctccgataacaaagatatttttaaggatcacggaagattcctttaaaaacagtgtatttgtaagggttcggagtatctgcgggtatgccagatctacgatgctgatgaaggccgcgcagagcagatcaaaaaagaaaacagccttgtaaggaccgtaatatttgatgaattttttataagtatccataatataagactccattctcatagtaaatatcagtgatagtaaagattctaacacaggacagaaagcatgtaaacagaggaatgtaaaatatgcttgacattaaatgtaaagcgaactatactaatattgtaaagcaaactatacaaaaaagggtgtgcatatgaaaacaagaattcaggaattgagaaaggatcaaaaggtgacacagatggagctggccgaatccgtaggggtgacccggcagaccattatctctctggaaaacggcaggtacaaagcctcgctggtgctggcccacaagattgcgcagttttttggagtaacgatcgaggatatttttatatttgatcaggaggaggaaaacttatgttaggattattttgtgcaggcaatgccaggaatgatgaagaatatgggagggcagtcaggagtaaataagatcaatgaacatatgatatccacgtatgcaggagtggggtcaggaatcatgacagcagccgtggtcctttggatacggtttcagctcatattgaaaaatccgaaaaagctgaaagaaatgcggctcagcaataccgacgagagaaatcaggagattggaaagaaggcatacagatttgcctccaccggactgatcatggcactttatctcatctgtctgatcggaggtctgtggtatccggtcttgatcagtgtcgtaggaatacttatgtggatcttcctgctcacttatgtaatctcttataaagtgtttgaaagaaaaatgtaaaaaaagaaatatccgggaacagttgatttgctgccatcccggatgttttttatttcatttcataggaaagttctacgaccttccctatgaaataaaaacgctccgcgggttgtgcacagatgcgtaaggaaattatttgcctgcggcaaattgcatctggcacgcaaagttgtcaagcccctcaaagagtgagtgaggggttggggcgttgaagtgggcttgcccactttgttcttttcatccctgctgtgcagccgattctttttgttcccatttcttgcttttaaaatagcaaaaaccggcgatggcaggcagcagggatgacagagcctgccccagatagattccggggaatcccagtttaagaggaaatgcaaacagccagctcaggggcaggcgtacgatgacggcatctaaaactgcatttaccatggcaatatgggaagaacctataccgattgcgaaggaatcaaacgtatacataactgcatagaccagactgtttgcaccacagcatattcggaggtacaaaatcccgcttttcaggacctccggactcgaggggtcaaacagcataatgatgggctcagcaaagatctggacgatcagaacagagaacagcgtcaccatgacattgagacggagaccggtcagggttgtttttttcacgcgccggatatcatttgcacctatattttgaccggccatggctgtgactgcctgccccacagcccagcacggcatgcctgcaaaagtattgattttcagcccgacaccggatgccgctgcggcggctgtaccgaaattgttgagcatacctgtaatcaatagataagaaatattgacgatgatcatctggccggccgccggcagaccaattttcataatgactgccagcttatcggctttgaccgcaaagtttctgattttaaaatcaaagacaaagttcctgcgtttcagatgaatgactgcggttacaagtgaaataccctgggaaaaaactgtcgcgtaagccgctcctctcgttccgattcccagataagagactaaaagcagatccagtatgatattaacggcagcagccaccgcgacaaagtaaagcggactctttgaatctccgagccccttcataaccgagcaaacggaatgatacccaaatacaaaaacagttccccagcagatgatttccatgtatgcacaggcatcctgcattgcatcggcaggaatttttaataaaataaaaagcggtctgcagaatagaagtccaagtatggttataaaaagcgaagcgataaaggtaactgaaaaaagcgttccggttgtttccgcctggccttttatgtcgccggctcctttaaattgggcgatcagtacagtcccgcccatggtgattcccaggcagaaagaattaataataaaacagagcatggaggcgttgcttacagcggcaagcccggcttttccgacggtccttccgaccaccagcatatctgcgatgctgtaaaatgattgcagcagattagctgacaggagagggagtgcgaacaggaccagattttttgtaatgtttcctttggtcaggttttgtttttctttcattttcatgttcctttcaaaaaagcagagggcatcattaaaagggtgtgccctctgttcatataaataaaaaatacaaaaggcagcagacaaaacattgtccgctgcccaggtatgatttatttccagctgtgaaaaacatacaaacaaaacctgatgtctccatcagtgtttggcatacttcttcataatcttggctccgtacaatgttttgaatcatcaaattgtatggagctttcatcaatacataattttccgaatatcattgtactcaccctttcttttcgttgataagataactataaaggtctcagcttcctatgtcaagcacttcataaatatgtctaaagctttctgcagcggttgaacgccgcatggatctcctgccgtctcggcattgccagattagatctcacatatccgctgtccagtatcgccgcaagccctttggcgtcgatgagcgctaaaagttcctctgcgatttggcgcaggtcttttctgccgtcgatcagatgcagctgggcataaagcagagcataggcgagagctgttgtctgctcagagtcacagatctgttctgcataccgcaggtccacagtctctttgttgatctggaatgcgtcttttccgagggtttttaatttgttccggctgtttttcagggacggacggctggggtttacaacacggtgaaaagaagggctgtccggcttttctttcggaattgttaccggcggaaaggctttggactcctcttttgcaaagtctgtgatctccctcggcacatagcggtccatctgtaaaatgtggtcggcaacctggaaataagccccggagcttcctgccacaatgacggaagaaataccgtggtcttcatacagtccccggacccgttcaataaacggagtaataggctcatgatccctgtggaccactctctgcatcagttcgtcacgaatcataaagttggtggcgctggtgtcttcatcgatgaggaaaagagaagttccggcctccatactctcgatcacattggccgcctgggaggtgctgccgctggcgtcttcagtggagaaagaaaccgtatcttttccgtttggaagattattgataaacagggaaatatctgtgttttttatgctgcgcccgtcctctgcgcggagttttaccgccgtgtcatcggtgatgacatattcacggccgtcatttcttatatggttgtaaacacctaattccaatgctttcagcagtgttgattttccatgatagcccccgcctacgatcaaggtaatgccttttggtattcccatgccggagaggggaccgtgatgaggaagatttaatgtgactttcagggagtccggcgaatggaaagccacagcctgcctcatcggacgcggagataccccgctctcccttgggaggacagaaccatctgctacaaaagcacagagattcagcttcggaagctggtcacgaatatatttttgatcttcagcaagactgatcacatcttcgacggcgcctacgttaagcttcttataatagaaggaagacaatacacagtcgggaagaaagtcaaacaggattttgatcagttcaaatgcggcgatggtccggcccctggcaggaaatccgatctcaaaatggacagagatatcaccggactcgggatggatggacagggcggtccgctctaaaatctcctgcccgcatctactgacagaaatcaggccgctcttgcctgaaccctttgccttaaaattataggattccagtttctttccgaaaacgcgggtcagatagtcctgaagtgcggtccgcttatggggctggtcaaacagttctaaagggaatccggcttttatgccggggatgctgaggcttactttggagggagaggcaaagggatctccctgtacatggtcaatatgcagggtatagccgccgaaccggtaactccccctggtgtctttataggcaggatagcctttatggtcgatacgctctaacagcgatcttaaatcatctgaagtcttcatatgttctatcacctttcaaaatatgagttttttaccactatttccgtcacgctttgaaatgcgttcctccaatagcgttaaaatactttcgttggataaagatacttgtctgatggatacctatccagttgatattacgtccattttctgcatgattggagtgaggcattctaagagccgaacgggaaatcatgtggaaaatgtcatcataagtatcccacgattaattcggtcagtcaatctggtccgagtattttttttctttcaatggcaaacactgcgggcagttgatataatagatgaaaggaggattagccgatggaaattgaaagagtctgggcagtttatttcagcgctacagatacaacgaagaaaattgtgacggttttagccggggaggcggcccgaacactgcgtgcagagtactgtgaatatgactttacgctgcctgcttcaagaaaggatcttcttgtttttggaccccgggatcttgtgatcttcgggacgccggtatatgcggggagagtgccaaatgttctgcttgactttctgaaagagtatatcaagggaaatcatgcctgtgcggtgccggtcacggtttacggcaacagaaactatgacgatgccctgatcgagcttcgggatcttttagagcagaacaggtttcatactgtggcagcagcagctttcgtgggcgaacactctttttcggataccttgggcagagggcggccggataacagggatgtgagccttataagggagtttgcattcgggctctgcgaacgtttgaagaggactgaaaaagaagattacagccgtccggtatacgtaaaagggatccggaagccatacagaggctattaccggcccagagacagaaaaggaaaattcattgatatcagaaaagtaaagcccttaacctccggggactgtgacggctgcggaatctgtgcaaaagtctgccccatgggttctataaggcgtgaagatgttgggacagtggacgggatctgcattaaatgcggggcctgtatcaagaaatgcccgagacatgcaaaatattatgaggatgaagggtatctgtaccataagacagaattggaagaacagtatacaaagagggctgagcctgagatttttttctgaatacatagtgggaggaacggatgattaaaaatgtgatatttgatataagaaatgttcttgcagattttgggtaggagagattatttttgaggctgggttttgaaggagaagcattttattcgctggcgccggaatataaagagcagattgacctgctctatgagcgcattcacaagatgaccgaagaatattcttatgcatccggaagagcctgtctttatcggtgatatggaggaaaatattaccgcggcaaaactatatggatacgaaggaatcgtatttaaaagcaggaaacaaacagagaaaaagcttgcagagctcagcatctgaaaataaagattgtgctttttatagttcgtttattaaaaaatatcaggatattctcagagaatatgaaatttctccggagctggtcccgctggagattacggaaagcgtcatgtcagaggctgaggtgctgctgagaaatattatagatgaacttcacagcatcggtttttctgtgcttatggatgactttggaacgggctacttttccatgacgatgcttggcaccatgccgatcgatgtgctgaagcttgataaaagtttgtggacgatatcggggagagcaaaggagagaagatcgtaaggagcattattgatctgtcgagaggtctgggtatccgtctcacggcggaggaggtcgagacagaggagcagtacaaatttttgaggaaactgaaatgtgatgaaatccagggatattattttgtaaagccaatgtcgggcgctgtttttcaagctttattgaagactgacaaataaagtacagaaaaatatacaataattttaaaaaaaaatgaaatttcctcttccattttggggccagacgtaatataatagcaaaagcggggcatggctcagcttggtagagcgcgtggttcgggactacgaggtcgcaggttcaaatcctgttgccccgactgctgaaagcatcagacgaaagtctggtgttttttcatttcataggaaagttctacgaccttccctatgaaataaaaacgctctgcgagctgtacacagatgcataaggaaattatttgactgcgtcaaatcgtatctggcacgcaaagttatcaagcccctcaaagaatgagaggttggggagatgaggtggtcttgaccactttgtccttttgaaaatcctgttgccccttgttatcttttttttcacgtcgtataatagtattttgtggggcagactgttttctgccgttcagaacagagaaaaatagggagaattattttatatgaagaagaaaaaattaggcctgctgatccggctgctgatcggtatcacagcgggtatgctgatcggctctgccggagatatattcggcgtcggggatacgtttatctttaaaggcgtaatccgtctttttgttacttttactacattgttcagtacatttttaaattttattattccgctgctgattctttcttttgtggccgcaggactggccgacctggggaagaaggccaataagctgtttggggtgactctgctgctcgcatacgcatctacggtgatcgcagggatcagtgcattttttgcgggaaaggcacttcttccttacctgattcagcggatcaccggcagcgagatccagaccaggtcttttgaagccatctttgcgattcaggctgacccggtgttcggagttatgacggctctgatcctggcgttccttttaggacttggaatcgcaaacagtaaaaatgatacgctgctgctttgtttaaaggatcttcaggagatcatcaccaagacattaaacaagattatcataccgatgatcccgttttacgtggcagggctgttcagtaaaatagcagccgaagggaaactgcttccgaccataaagatgtttgttaaactgtatgtgatgatcctgatctttcagtggctttacattgcatttcagtttttgatatccacactgtttacgaaagagaacaagtttaagaatttaagaggcattgcgccggcgtattttacggcactgggtacacagtcttccgcatcgacgatcccggtaaaccttgaaagcagtaaggacagcggtgtgtcagaagatattgcagactttgtcattccattatgtgcgacaatccatctctccggagacacgatctgtctggtaatcggttccatgggtattatgctcgccaacggactgacgccgacattgtccatgtttcttccgtttatttttatgctgggtattaccatggtggcggctccgggagttccgggaggcggagtcatggcggctctcggcctcatcaaatctatgcttcattttacagacccgatgagccagctgatcatttctcttcatttttcccaggacagctttgggacggcctgcaatattacgggcgatcaggcaatcgcttacatggtcgacagcatcgacagaaaaaacggagaaaagaaatagggaatggaaaaaagaaaggaattatttaccaataaagatttgaaaaagctgatcattccgctgatcatcgaacagcttctgacggtaaccgtgggtcttgccgactccattatgatctccagcgtgggagaggcggcggtctcaggggtgtctctggtggacagcatcatgattctgctcatcaacatgttttcggctctggccaccgggggagccgtggtggcaggccagtatctgggccagaaaaagcacgtgatggcctgcaagaccgcagaccagctgatcttatttatttcagccctggctgcggtgatcatggccggcatttatgcaatgagaggctttatcctccacggagttttcggggccattgaaccggcagttatgcacagcgcggaagtttatcttctgatcgtgacggcgtcgattccgtttctggcagtttacaacggatgtgcggccttgttcaggactatggggaattccaagacagccatgcagatgtcactctttatgaatgctgtcaatatcataggcaacgctgtcctgatctacggtgtgggaatgggcgtggaaggagcggcgattcctacgctggcatcccgggtaatcgctgcggcagtgatccttgtgcttttgaaaaacaggaatcaggcagtccatatcagcagaaattttaatttcaagttcaaaggttttttggtcggcagaatattgaagatcggtgtccccaacggggtggaaaacagcatgtttcagcttggaaagattcttgttttaagcctggttgccgggtttgggactgcatcgatcacggccaatgcagtcagcaacatggtggctatgtttgagatcatcccgggaatggcagtagggcttgcggtgctgactgttgtatccagatgtgtaggtgccaatgattatgaggcagcccggtattatacaaagaaactgttaaagatcgcctacgcttccctgatcgtgtttaacctgtttattgttgccatgcttcctgtgatcatccgggcatatcatctgtcgccggagaccgcggccattacaagaaagatcttgctgtaccacacactgtgctgtgtgacgatctggcctgtttcctttactctgcccaatactctcagggcttccaatgatgtaaagtacacgatggtcaccgcaatcatttctatgtggatctttcgaatctttttcagctttgtcctcgggaaatggcttggatggggagtgtttggagtatgggtcgcaatgacactggactgggcggtgcgggccgtgcttttcctgatccggtacataaaaggcaagtggcagtacaggacgatttaacttgacaagaacgagacaatcgtgtaaattaataggcataagctattggtttgatagataaaagttattaattcagaacgaaagcagcaatattcggagattatcatgtcagcaaaaggtaaaatgacaaatacatatggtttttcattttatttctggggttattattttaatcccggctttttgcgctacaatgaatcatctcctgaaatccggtagaaagatccatcggtaaagatcatttttaggacctgtattcttgtagtggaatacaggtcctttttatttcacagaaaaggttataacctttcctgttcgcaggcaaaaatctatttaattttcaaggaggaaaagtacaatgattattattttaaagaatgacgcagaaaaacagcaggtggaagaattaaagcaggagatggtatcccagggctttgccattcatgaatctgcagggatcaacacccagcttttagggctgatcggggacacatccaaggtcgatgtcgaccatgtgatggcaaatgatattgtggagaccgtgcagcggattcaggaaccatacaagaaggcaaacaggaagttccatccgaatgacacggctgtggatatcgcgggagtaaagataggcggaggagagtttcaggtgatcgccggtccgtgctccattgagacgaaagagcagatgacagaagtggcacagaaggtaaaagaagcaggagcaggtcttctgcgcggaggggcatttaagccgaggacatcaccttacgctttccaggggctccacgatgaggggctcaggcttctgctggaggctaaaaaagccacgggtcttcccgtggtgacagagatcatggatgccagccatcttcctctgtttgagggtgtggacctgatccaggtgggaaccagaaatatgcagaactttgaactgttaaaagaacttggcaagatagataaaccaattcttttaaagagaggaatggcctgtaccattgacgagtggcttatgagcgccgagtacatcatggcaggcgggaatgagaacgtgatcttgtgtgagcgggggatcaggacttacgagaccgcggtgagaaatacgctggatctgtccgccattccgatgatcaagaagaaatcccatctcccggttatcgtagatccttctcacgccacaggcatccgtttcatggtagagcctatggcccttgccgccattgcggcgggcgccgacggcctgatggtagaggtacacaacaatccggccaaggcactctgcgacggccctcagtcactgacaccggaaggatttgaccatatgatgcagaaggtgatgaaaacaagagacttctttcaaaatttataatcttttgttatactggttccagacttatttgaaaagaaaaggaatcaggacaaaggagcagcaaaatgaaagtaatcgtcggactgggcaatcccggaagacagtatgaacggaccagacacaacatcggctttgaagccattgattatattgccgggaaaaaccagatagaaatttcttcaagaaagcataaggcgctcatcggaagcggatacttaggaggacagagggtactgctcgtaaagccgcagacctttatgaacttaagcggggagagccttcggggaatcatggacttttacaaactggagccttcagactttattgtaatattcgatgatatttctctggacgtagggcagctcaggatcaggagaaagggcagtgccggaggccataacgggatcaagagcatcatcagccatctgggaagcatggattttccgcgggtaaaaataggagtcggagaaaagcccaagggatatgatctggcagactacgtgctgggccattttttaaagaatgaactggaaatttatgatgatgtgtttccggatgtggacaatgcggtgaaacttatggtgatagatgacatatccggggctatgaaccaatataataaaaaagcgaggaagtaaccgcagcagaaagtaaggaatgagacgtgttagatcatatttttgagaatgatgcagtgtttgaacagataaaaacaggccttgagaacaatcagggccctgttttagtgtcaggatgtacggacggggcaaaagcccatctggtcagtgcactgagaggaaaaaagaagcgcggtaactataaggtgatcgtgacagcagatgagaataaggccaaggagtgggtggaaaactatcggttcttcggggaagacgccgtctactttcctgccaaagacccgctgttttacagcgccgacatccatggaaatgccattgcaaaagaacggctcagggggatcgagagtatcatcaaaggacagggaggtgtcttcgtcctttctgtcgacgccctgatggaccgggttgtaccccttgcggagatcaagaaaaaccgggtgatgatcagcctggagacagaggtttccgagcaggagattacgaaaaaatttaccgctatggggtatgagaggactccatttgtagaggcggccggagaatttgcggtcaggggcgggatcatcgacatttacccgtttacatcggactgcccgtacaggattgaactctggggggaggaggtcgattcgatccgcagttttgatgcccagagtcagcggtccattgaagaagtaaagagtctgacggtctatcctgccacggagattgttttaagcgaagaacggatctcacagggactaaaaaagatcgaggccgagtatcaggacttgaaagagacgttccacaaagcctttgagacggacaaagaggtcaggctcacgaaggaatttcagaggatcagagaagagctctcggaactttccatgctcatcggagtagaaggatatcttccgtatttttatgacaggctggtgtgtttccttgactatttcccgaaaaataccgcggtctatgtggatgagccgcagcatgtggaagagaggggacggggctttttcctggagtttacggagagcatgaaaagccgtctggaggccggatatctgctgccgggacagatggatacggtagcttgttttgacgagactctgaaccgcctgctgaaacagccggccgttttcttggcttcactggcatctgaggtgaaggctgcgaaggcggcagacacatttttcatggagacaaagtctgtccagtcctacaacaacagctttgagcagctgatcaaggacctgagaaggtaccagaaaaaagaatatcggattcttgttgtctccccttcggtgaccagagcaaaacgcctggctgaggatatgagagacagcggactgactgtcacatatgataagaaaccgtcagaagatatggttcccggacagatcgtcatcacgccaggcaaattaaagagcggcatcgaatacccggagacgaaatgggtgctgatctctgagagcgatattttcagcggaaggaaagaaaaacgcaggaagaaagccgcttttaagggaaaaggcgagaagataaagaacttcgcggatatttccatcggcgactatgtagttcatgaaaagcacggcgtcggaatctaccggggaattgaaaaaatcaccgtaaacaacgtcgagaaggactatatcagcatcgagtataaaggcggggacaatctgtttattcttgcctcggccctggaccagatcgcaaaatacgccagcgccaatgcaaagaagccccggcttaacaagctgggagggaatgagtggaagaagaccacgaaacgggtcaggggccaggtgcgtgaaaccgccaaagagctggtggagctgtatgcggtccggcaggccaaagaagggtatgtctatgataaagatacggtttggcagagagagtttgaggaaatgtttccttatgaggaaacgcaggaccagctcaatgccatagaggacgtgaagcgggacatggaaagtacgaaaatcatggaccggctcatctgcggggatgtgggatacggaaagacggaagtagccatccgggcggccttcaaggctgtgaccaacggaaaacaggtggcatatctggtacctacaacgattcttgcccagcagcactacaatacattctgcgagcgctttcagaattatccgatgaccgtcagggtgatgtccagattctgtactcccagggaacagaaagagacgatggaaggcctgaaaaaaggaatcgtggatgtggtcatcgggacacaccggctcctttccaaagacgtgaagtataaagacctgggacttttgatcatagatgaagaacagcgtttcggcgtgggacataaagagaagatcaagacactgaagaaagatgtggacgtgctttctctctccgcaacaccgattccgaggacgctgcatatgagtctgatcgggatcagggatatgagcattttagaggaacctccccacgaccgaagagcgatccagacttatgtgatggaatacaacgaggagctcgtaaaagaagcagtccaccgggagatgacgagaggcggtcaggtatactatgtatataaccgggtcaataacattgcggagatcacgagtgagctccagaaactcctgcccaatgcaaaagtggcatttgcccacggacagatgcgggagagggaacttgaaaatatcatgatgcagtttatggaaaaggagatcgacgtgctcgtctccacgactatcattgagaccgggctggatataccgaacgtgaacacgatgatcattcatgacgccaaccagctgggactttcccagttatatcagctaaggggacgcgtcgggcgctccaaccggaacgcatttgcatttttaatgtataaaagggacactttattaaaagagacagcggagaaaaggctccaggcgatccgggaatttacggacctgggatcgggatacaagatcgccatgcgggatctggagattcggggagcgggaaatctgctgggggaagaacagtccggccatatggaagcggtgggatatgatctgtactgtaagatgctcaatgacgcagtgctgagactcaaaggtgaactttcagaggatacggattttgacacgacactggatctgaatattgatgcctttcttccatccgcctatatcagaaacgaagtggagaagctggagctttataaacggatatctgccatcgagacgaaggatgagctggaagatatgcaggatgagctcctggaccgtttcggcgatctcccggcagcggtggtcaatctgctccatatcgctctgttaaaatctatggctcaccacgcttatatgacggatgtgaaacagaagggcgagaaagtattctttgagatgaatccggaggcaaatgtgcaggtggagaagatcccggatgtgctgaacgaatttccgaaggaactctctgtcagtgccggggagcatcctgtatttgtactggatctttcatccgcgaagaaaagcgcatggctttcaaagattgaacattgtgtgaactcattggatgcgttgattatcagatcgtaatgtagtataatccaaaatggaaataaattaaacggaggaaacgaagaatgaaacgtgtagcgaagaagatcgtatgtcttgcggcggttatggctttgtgcgcggccttattggcgggctgcaagaagcaggatgacaagacgctgtttgaatatgcaggaaataaggtgacctataaggaagcccatgtatatgccaggatcatgcagtacagcgcagagcagcagtacgcatcctatttaggcgataaactgtggtctacccaggtcggtaccgataaaaagggcaaaaagatcacaatgcaggattcaattaaagacaatgtcatcaaccagatcaagactgtaaaagtattggccgaccacgcagatgactacaaggtaaagcttacttcggatgagaagaaacagctggacgaatccgtaaaatcttttacaaaaaatgaacttggaaaacgtgtcatgaaggtgaccggggcagacaaagattacatcaaggaaattcagcaggaaaatctgatcgcccagaaggttatgaatgcgatcattgaaaaggcagatgtgaaagtgacagacgacgaagcgaagaccgtaaaagtatacaagctcgttttcacgacgaagaaaacagacagcaagaccggcaaagaagtaaatatgactgcaaaagaaaaggcagctcagttaaagaaagccaaagaagcattaaaggcgatcaagaaaggccagagcgtcaaggcagtagccaaaaagtataaagtcgacacagacaacgaagaaagctacacaaagggaaaagcagctctcggaaccaagtttgaagatgcggcttccaaattaaagaagaatcaggtcagcggcgtagtcgagacagacgatgcgtatgtcattatcaagatgctgaacccgaatgtaaagagtgagcttgccacatccaagagtacgcttctgcaggaaaaacagcaggaagcataccagaaggtatataaaaagtggacgaaggatgcagacaaggagtgggacgatgacaagagcatcgatcaggaactgtggaaaaagatcacatttaagtataaggcaacgactacagctaccgaaaaaacgaccacagaagccacaaccacagcaaagcagaaagcaacgacagagaagaaaaagtaatacagctctttgtgaaaggcagcccatgatccggctgcctttttcgtaaagatcagagaaaaggaggcagtgtatggaatttcagatcggcgatgtgatcaaaatgaagaaacctcatccgtgcgggagcaatgagtgggagatattgagggtcggcatggatttccggctgaaatgtacgggctgcggccggcaggtaatggtgtcaaggaagctcgtggagaagaatttcaggggatttgtgaaaaaagcttgcggttaaaaggaatttatggtaacatatcaacttgtgatatataaatttatccttgctcttggcagaagatcaagagccgaaaagaccagaaggaggtgcagataacatgagtaaatatgaactcgcattagtcgtgaatgctaagatcgaagacgaagcaagagcggaagtagtggaaaaagcaaaagctatgattacagaagcaggagctgagatcacgaatgtcgatgaatggggaaagaagcgtttagcttacgagatccagaagatgagagaaggatactactacttcatccagttcgacgcagagacagaagttccggctgttttagaagaaaaacttcgaattacagaaaatgtattacgttatttagtcgtaaaacaggatgcctaacactttgataggcaggaggaatccaatatgaataaagtgattttgatgggccgtcttaccagagacccggacgtgagatactcacagggtgagagagcgacggcagttgcaagatatactttagctgtaaacaggagattcaagagggatggcgaaccggatgcagactttatcaactgtgtcgcatttggacgtgccggcgaatttgccgagaagtattttcgccagggaatcaagattgtcatctcaggaagaatccagacaggcagttacaccaacaaggacggaatcaaggtctataccaccgatgttattgtagaagaacaggatttctgcgagagcaaagcggcaactgaccagtacaacggaggaggaatgcagacagcaaatccttcgaagccgccgcagccgagccaggccgcaggagacggttttatgaacattccggacggattggaagaggaactgccatttagttaaattaggaggtttaatcatggcttataatagaggtgattctccaaacaggagaagaggcggacgcagaagaagaaaagtatgtgcattctgtacagaagccgatgccgttatcgattacaaagatgtagcgacattaaagaaatatgtttctgagagaggcaagatcctgccgagacgtatcacaggaacatgtgcaaagcatcagagagctgtcacaagcgcgatcaaaagagcaagacatctcgctttaatgccttacacacaggactaataaaagacaagccgccgtatccctatggatatggcggtttttttgaccttgcctgccagtcatgctataatgaaaaatacaatatttgaatccgaggtttaaggagccgtatcatgaaaaataaaaatacaagtataagcgtcagcaaagatatcgtctggcccgttctggccggactgttgtttttgatggcagacatcctggtgttttccattgacgtgaagtccgggatcatcctggcctgttttgtactgatcttctttttgttttccgtgctttattatccgtattataagaagaagatgacacaggaaacgatggactttttattcgagcagagccgggtccagaaccatttgatcaaagagctgcccctgccctatgtactgattggcggggacggggatatcatgtggtataatcaggcatttgaaaagattttgaacgggaagaacatttccaagcttcagcagatgttccccgaattggacaagaatctgcttccgtcggagatgaatcatgcagtctcccacgtgaaaaaagagatcagggagaaagaacaggaaatgacctgcttttacaagatcgagtttgtgaggatccagatggacagtcttatcgatgaggagacagagagcaagtccaaacagtggctcagagaccagtcgatgattgccgcctatatctttgaccagaccatgctcaagatgtatatggagcagaacgaaaatcagcggatggtggtcggactgatctatattgataattatgatgaacttctggacaacgtggatgaagtaaaacagtccatgcttctggcgctgacagaccagaagatcaataaatttatccagaatatttcaggcattgtcaaaaagacggagaaggataagtatttgatcatctttcagcagaagtatctggagaaagtcaaagccgagaagtttcatattctggaggaagtcaagagtatcaatctcggaagcagcggcaatatgacgctgagcatcagccttggaatcaacggtcagagctaccaggaaaactacgaggctgcatgcacggccatggacctggctcttggacggggcggcgaccaggcggtgatcaaggacggcgaggatatttcctactacggggagaatgccgccgtagttgagaaaaatacgagagtcaaagccagagtcaaggcccacgcattgagagaacttctggagtccaaagaaaatgtagttattatgagccataaaataccggacccggatgccatgggggctgcggtgggattataccgcctggggctttctctgggcagaaaggcccacatcgtcatgaatgaggtgacgatttcggtgcgcccgatcatggaagaactgctgtcgtgtgaggaatacgacgaggacatgtttatctccagcgatacggccagggaaatcacggatgacaacaccctgctgatcgttgtggacgtaaatcatgcaagctataccgagtgtgaagatctgctggaacagaccaatacgatcgtcatactggaccaccacaggaaaggaaaagagacgattaagtatccggtcctctcttatatcgagccttatgcctcttctacgtgcgagctggtggcggaggttcttcagtatatcactacgaagcctaagcttctcccggtggaagtcaatgccatgtacttcggcatgctgattgatacggataattttgtcaacaagacaggggttcggacgttcgaagcggcggcgtttctgaaacggagcggagcagacttaaataaagtacggaaaatgtccaggaccagtatggactcatacagaatccgggcaaaagcggtcagcgatgctgagatcatgtatgattcctttgccattgctactctggtggggatcggcatcgacagtccgacggtggtcggggcccaggtggccaatgaacttttagatattgacggaatcaaggcatcctttgtattgaccggcgtggaagagcgcgtctatgtcagcgccagatcaattgacgaggtgaatgtacagaagattatggagcagttcggaggaggaggccatctgaccgtggccggtgcccagatggtcgatgtttccctgtatgacgcaaaacagatcatcaaggggactctgcagtttatgaaagaggaaggagacatataaaatgaaagttattttattgcaggatgtaaaaaatgtaggaaagaaagacgatatcgttgaagtgaatgacggatacgcaagaaatgtgctcctgcgcaagggactcggcgtggaagccagcaagaaagcggtcaacgatctgaagcttaagaaggccaatgaagacagagtggcaaaagagaaattagaggaggcaaagaaatttgccgaggaactcaaagaaaaggaagttatcttaaagatgaaagtgggagagggcggaagaaccttcggagccgtatctacaaaagagatcgcagaggctgccaaaaagcagctgggctatgaactggataaaaagaagatgcacacagagccgatcaaaacgctcggggtacacaatattgaagtgaaagtgcacccgaaagtgactgccacattaaaggtaaaagtacaagaggataaataaagacaatggatgaggcatttatcaagaaaatacaacccaacagcatggaggcagagcagtctgtcataggtgccatgatcatggacagggacgcgattgccgatgtttccgatattgtcaccaaagaggatttttatcagaagcagaacgggattctgtttgaatcgatgacagagctgtataaggaggggaaacccgtagatctggtcaccctccagaataagctgaaagaaaaagatgtgccggaatccatgaaaagcctggagtttataagggatcttctggaggtggtgcctacctctgccaacgccaagcagtatgcccggatcgtgaaagaaaagtccaccctgcgaaagctgatcagggttacggaggagatcacgaaggactgttatcttggaaaggaagaggttccacagatcctggaaaagacggaaaaggacgtgtttggtctcctgcaggaggccagcggccgtgaggattttgtctctatcgatcaggttgtattaaacacgctggagagcatagaggaagcggcggcctccgatggaaggatcaccggggttgccacagggtttgatgatcttgactttaagcttaccggccttcacccgtcggagctcattatggtggctgcaaggcctgccatgggtaagactgcatttgtcttaaacatcgcccagcatgctgcggtaagaaaacaggttcccacagctatattcagcctggaaatgtccaaggaacagctggtgactcgtatgatctccatggaggccatggtggactctcaggcgatccgtaccggagagcttcaggagagcgagtgggagaagatcatggagagtgccgggaccatcgggcgttcccctctgatcatcgatgatactccgggaatcactgtggcggaattaaggtccaaatgccgccgttataagcagacctacgggctgggcctgatcatcatcgactatttgcagctgatgtccggagggaaaaagtcagagtcaaggcagcaggagatctccgagatctctcgttccttaaaggcgctggccagagagatggatgcgccggtcatcgccctgtcacagctgagccgtatggtggagcagaggaaaccgcccaagccggtcctttccgacttgagggaatccggttccatcgagcaggatgccgacgtcgttatgttcatctacagggatgactattacaacgaagactctgaaaaaaagggtcttgcagagatcattgtggcaaaacagagaaatggttccacaggaagcgtggaacttgtctggttaggacagtatacgaagtttggaaataaagagagagtcaggatgtagcctgcagattatgatagaaaccgtcgtcttttagagggcggtttttcttgtcccgcaaagagcccccaccttataataaattaagaagaaaggaagggacttatgaaggaaaaaagacgaatgatttctgaagcagccaaagaattagggttagaaacctatactttaagggcctgggaggaagagctgaagcttaatattccgcggaatgacaaaggctaccgttactatggggaaaaagaactacatacatttatcaagatccgtgatatgagggatgagggtatgagcatggatgaaatcaaggaggctctgccaaagaatgtcattccttttcccgcaggcgggagcagtgtgggtccgcaggataaaatggaacagttccaaaatgttatggttaagattatgggacgggccttaaacgaacagaaaaatcagctgagccgggaaatcggagatcaggttaccaggcaggtggcaaaggaaatggattatcagttccgtcagaaggaggagtcggaagagaagagattccagaagctggacgagctgatccgcctgcagcagcagagcagggaagaaattgcagctacaaaagagagaggcttcttttttaggaagaaaaaaagaaaccgcgaataatcatcatcgcaaacaaaaaagagatgccgggcggcatctctttttatgtatcgattattcctggctgatagcgccggttggacatccgtctgcgcaagctccgcagtctaagcatgtatctgcatcgattacgtactgtccgtccccttcgctgatagctcctgccgggcaagtaccttcgcaagcgccgcaagagatacaagcgtctgaaattacatatgccatatctatattcctcctttaaaaagttgtgtatgaaatggcgggtgacccgcctttcaggtacttttcattttaatatacttaatatacaatatcaagggaattccggtgaattattgtatttttaattataatgtattatactaaataggattcttcttcagggatttatggagaagaacggcgactgttaagaatggaggtattataaatgaatacaatcacaaaggacatggtgatcggtgacctgcttgccatcgatgaaaacttcgcggctattttaatggcatccggcatgcactgcgtgggctgcccgtcttctcagggagagacactggaagaagctgcttttgttcacggaatgaatgtaaatgaacttctcggcagactgaatgaatatatggagacaaaacaggcctgacgccctgtcaccgtaagatttagaggacaaccttcagatgagattctggagattgtcttcttttttttgccctgatttatattttgcggtgcgttgtgcaatcggattgcgcatgcttgtgatgagcaattcaatgagcaactttgggacccaattcagattgttttagtgggtattacagggttacaatttaagagtactaagaatgaaataaaaagaaaaggagtgataatgtttgaaacgcgacatgatttacaaagacctgatccagctggatatggaagcggcagacaccgatgacttttttgacaagatggccgcaaaacttgaagaacttggttttgtaaagagctcattcgtggatgcgatcaagacaagagagaaaaacttcccgacggcattggcggtagagccgtatccggtggcgatccctcatgcagatccggaacatatcttaaagcctttcatcgcgccggtcagattaaaagaaccggtcaagtggtgtgaaatggcagcaaacgatgtggaacatgatgtgaagtttatctttatgcttggctttaagcgttccgacgagcacgtggaactgcttcagatccttgtggcaaacttccaggatgagtccctgatggaacgcctgatggatgcaaaaaccaaagaagagtatatggaagcgattctttccatggaaggactctgatcacagagtgaaagtaaatgaaaacaagggcttatctcaagaaaggaaataaaaattatgaaaaagatcattgtagcatgcggaagcggagtagcaacatctcagacagtagcaagcaaggtgaaccgtttattaaaagaaaataaggtagacgctcaggtggaagcggtagatttaaaatccgtagaccgctatatggattcaagcgtggcatatatcgcgatcacaaaaatcgacaaggagtatccgattccggtcatcaacggaatcgcattcttaaccggtgtaggtcaggatgcagaattgaaaaaactgatcgaagcatgtaaataagaggagaaaaactacaaaagacacatcgtaagaggatgaaaggagagattgtatgcaagtattgagttcagttgtcaactatctgttaagtttgggggcggcgattttcgttcctatcattatcattatcgccggactgatcgtaaggatgaaggtgaaagatgcggtttccgccggtattacactcggggtggcgtttacaggaatgacaatgctcatttccttcatgacggataccatcagcccagcggctcaggccatgttaaaatcaaccggtatttcactgcctatcgtggatggaggctggaccaccatgtcaaccatatcctggtcctggccatacgcatttttaatgttcccactgctgatcatcatcaatgtcatcatgctggtcattaacaaaacaaatacattcaacgccgatctttggaacgtatggggtaagatttttactgccgttgccgttgtagccatcacaaaacctcattttggaggggcaggatccattgcctgcgcatttgtggtagcagctatccagatcatttttgagctgaaagcggcagatatgcatcagcacagaatcgaaaagctttccggaattccgggtgtaacctgtacccataagatgaccttcctggcagctgtcatgtatccgatcgactgtattttaaagaaagtacctgcattaaacaaacagtttgacgcagcggcattaaaagataaagttggtatttttgcagagaaccatatccttggattcattcttggtattattttcggagttctcgccagatacagtgtagcagatactctgaccctggcgattaaggcagcgacagcgctgactctgttcccggtcatcacaaaatactttatgcaggcattggctccgatctctgaggcagtcagtgacttcatgaataagaaattctcaggaagaactctcgtagtagggcttgactggccgttcctcggaggatccaatgagatctggctggcagtgatctactctgtgccaatcacattattattctctatgttcctgccgggaaatgaaatccttccgtttgcaggtatcatcaaccttgcacttgccgtaccagcattccttgttactggaggaaacctgatccgtatgatcattctctgcaccgtcttcgcgccggtattcttatgggttggtactgcgttcgcgccgtttatgaccgaccttgcaaggacaacaggagcagtatccctgaaagcgggagagatgatctccaacagttccattgatggaccgatccagacttacgctttctcccatgtatttaaggtactggacggaaactttattccgctggccatcctgatcgtctgggtgatctgttttgtactctactacagaagccttagcaaagaagcacagcaggaaacaaacaactaaacgttttagacatagaaaaggggaagaattatgcagaggtttgtcaatgatccggattacgtcgtagaagatatgctcaaaggctttttaaaagcccacggagatcttgtcgtgaagtctgaggccaatgaccgtgtggtaaaatacataaatacaccggtggaaggaaaagtcggactggtaacaggcggcggcagcggacatgaacctgcttttcttggctatgtcggaaagaatatggtggatgctgtggcagtcggcgaagttttctcttcgccgtccgcccaggcattctatgacgcatttatggaggcggacgctggagaaggcgtggcctgtctgtttggaaactatgccggagacaacatgaatgtaaaaatggctgtacgaaaagcgaaaaaagccggtgtcactgtaaagtatgtaaccgcaaacgatgatgtggcttcatctccgaaggaaacgaaggaaaaacgccatggtatcgcaggcggcgtttttatgtggaagatcgggggagccagggcagcaaaaggcggagatctggatgaggtcattgcatctgcccaaaaagcagtggacaatacaagaagtatctgtgtaggattaagtccatgtgccatacctgcagttggacatcccaatttccatatcgaagaaggaactatggaggtggggatcggacaccacggggaaccgggcattaatgtgcaggacctggagcctgccgcaaagattgcagagaacatggctgaaacagtagcaaacgacctggaactcagagaaggggaagaggcggcggtgctgctttccggtctcggggcgacaccggtcatggaactgtatgtactgtacgatgaaattgaaagatacctgagagaaaagggaatttccgtttataagacttttattggggactatgtgacttcccttgatatgaacggagccgcgctgacggtcatgcgcctggatgatgaattaaaggaactgctggattacgaggcaaaatcaccgggcattgaggttaccagatagcaccggaacgatgaaagagggattctagtgtatttagacgaaagaggctatttagtattaaaaacaattgtaaataatccgtctataactggaaaggaagtggagcagtcattagatttgtccaggaagcaggtcagctatacgatggataagattaaccagtacctggcggataacggactgcccaagatagaaagactgcgcaccgggaaatttgtgataccggttcctgtgctggaacagtaccagaccgaggatatcgggatcaaagacagtacctatgtgtactccgacaaagaacggggagctctgatcttcctgatccttctgtgcacaagggaagaattatcaatttaccattttacatcaaagctggatatcagcaagaatacatttttgatcgacgttaaaaaactggaggaaaggctggcgccgtacggccttggaatccattacagcagacaggacggatatcatctggccggaagtgagttctgcaaacgggaggccatgatccctattgtgcggcagatcttaaatatgccgaacgggcaggaagccattatggagatttcccaggtcgatccggaactcatggagcaggtgcgggggcagatcagtgagattgagaataagttaaagatccgtttcaccgatgaaaggctgagggaacttccgtatatcctctgtctggtgctgattcgcatcaagaaagggagaattctggaagatcttcctgagtccttccagcatatcgccggaacaaaagagtattctgtcatggtggagtttgcaaaagagcacgacgtggcatggcagacggaaaagatcttttttgccgcgcagattcagatttccaactatcacagtttccagtcggataatttgagaagcgaagtggagatcatggaggcggccagacaggtcatcgacaattttgagaagattatatgcgtcaacatcaaggagcaggacattcttcttgaagcgctctttcagcatgtgaagccggcgttttaccgggtcaaataccactatcatattgaacagagtattgtagacatggtacttccgagatacagttccctgcacgccatggtaaagagatccatgaaaccgctggaggaactggcgggaagtgaatttcccgatgaagagctggtttatattacagcgctcttcggggcatggcttcagagagaaggaatcctggacatagaaaatcagaaaaaaagagctgtgatcgtctgtgccaacggggtgtcggtttccaacttcttatttttcacactgcgggagctgtttccggagatcgagttcctcacatgcctttctatgagggattttaccgaatacaaagaagaatttgaattagtctttactatggtccggctggagacggataaacttcagtttctcgtaaaaccatttctcgatgaagcctccaagcataagttcagggaaaaggtgctgagtgagattaacggtattatgccccatgaagtggatgtgacagaaattgtaagggctgtggagcagcacgcagtcattgaggaccgggacgcgctggtcagagagataaacagagtcttaaaccctgtaaatgtccagggaactgcagaaagaacagcggagataaaagaacagcccatgctggcagatgtacttacaaaggaaacaattcggatatcagagaagccgatggaatgggaagatgccgtaaggacggcgtcggctccgctgcttgcacggggagatatcgaacagcgctatgtggagcggatggtccagatcatccgggaagataagccatatattatgatcgctgacggagtcattattgcccatgcgggagtggaggacggagccgggaggatctgcatctctttgttaaagcttccggaaaggattgacatcaatgggtacctgaacgcggatattgtcatagttcttgggactccggatgccaccaatcatttgggagtgctgttccagctgaatgagatcctggaggacccgtctgcattaaagaagctgaagcaggcaaaacagccggaagagatccttaccattgttcaaaaagaaaaggagaaatcattatgttagaatcattaaaaaaggatgtagttcagattgcaaaaagagctcagaaggacggactgtgcaagcatttgtccggaaacttcagtgccagggataaagagacaggctatgtagtcatcacaccgactcaggtggacagagaacttctcacggcaagggatatggttgtcttagacctggatgccaatgtcatcgagaacctttccgggctgcgtccgaccagtgagtctttaatgcatttacagatttataagacgagaccggaggtcaatgcagttgcgcatacacattcaatgtatgctaccacctttgcggtgctgaaaaaaccgatcccggctgttgtatacgaagttgccaatttaggagtgagcaaatccagaattccggtggctccatacggacgcccaggttccacggatctctccgacagcgttattgaaccagttcaggaagcagattgtttcctgcttcagggacacggcgccgttgccgtagacagcagagaaatttacgatgcttacctgaaagcctcctatattgaagaacttgctcagttatacttcaattctctcgttgcaaacagaggacaggagccggattacttccctccggaagaattacagagctgggcatatccttcacagattaaattcccaaataaataaggagtgtgagagatgaagaaaattatcaatgagccggacaattatttaaaggagatgctcagcggcatctatatcgcacatgaagacatggtgacctgcacagacggtgaccttcagtgccttgtgtctaaacacaaaaaagaaggaaaagtcggcatcgccacaggaggcggttccggtcatcttcctttgttccttggctatgttggagaaggcatgctggacggctgctgcgtgggtgacgtatttcaatctccgagtgcagatcagatgcttgccgtgacaaaagagattgacagcggggcaggcgtgctctatatttacggaaattacaacggagatatctttaactttgatatggcggccgagatggcagacatggaagaggatatccgtgtggagaccgttctcggagccgatgacgtggcttctgccggtccttccgcaccgggggagaagagcacccgccggggagtggcaggtattttctttgtatttaagtgtgcaggagctgcagcagataaaatgatggatctggacaatgtaaagagaattgcagacaaagccaatgccaatgttcggactatgggagtcgctcttaccccttgtgtggtgccgagagttggtaaagcaggattctccatcggcgaagatgagatggagatcggcatgggcatccacggagagaccggtatcagacggggaaaaattgagccggcggaccagattgtagatgagatgttaggccagatcgttgcggatcttccttatgagagcggcgatgaggtggctgtcctcgtaaacggccttggagccaccactttagatgaacagtatattgtgacccgccgcatcgataaggtgctctcagaaaagggaatcagtgttcacagatattatgtgggagagtatgccacagcactggagatggcaggattttcaatctctcttctgaagctggatgatgagctcaaagaaatgctggacagtgatgcgaagacaccgttcttccgccagtaagtgaggaggcagaattaggaatggataacagttatttaatcaggcttttgaaagaaatcagtgacatcatggcagaaaacagggatcacctgattgagatggacagcattgtgggagacggtgacctgggacttacgatgggagatggattcaaggctgcctatgagaaagctgcggatgggtccgttacagatgccggaaagcttttataccaggccggaaaggccatggcatctgccgtgccgtctacgatgggtacactgatggcgtccggcctgatgcaggcgggcaaagtcctgaagggtacggaaacgcttgaaaatgccgatgtggcaaagatttttgaggcctatgaagcaggtgttgcaaaccgcggaaaagccaaagtgggagaaaagacgttcattgacggtatccacccggcggtggaaagtctgaatgccgctgcggcattgggtgctcccttggaagagatggcagccggtgcagtgaaagcagcagaggacggatttaagagtacgactactatgcttgcggttcacggacgcgccgcaaccaggggagaggcttccagaagccttgaagatccgggagcttatgtggcggtgcttattatgaaggcgtttgagaagagtacaaaataaacagaatgtgctaaggagagaccggtcctgcaaaatattgcaggatcggttttttgtatttttcttattaaaatccaattacttgaaaaaaagaatctttcatgatataatagtaaaaatagttgttgagaagttgaataaaataaatatattgtggagaaatgttttaatgatagaaagagatttaacgagcagagaaatatggattatgaagtgtatatgggctaatcccggggggatgacattacaagatctccagaaagaactaaaagaaatatttgattgggaaataaaaagatctacgatacacacctacctgacaacgatagaaggaaaaggatatatagaagtcgagaagaagggaagaaacttaattatgaaaccgtctatcagcgaagaagaacataagaaagagcaggcagagaggatgatcagcttttggtatgacgggtcaagacaaggacttattaaaacactggtaggggataatatttctcaagagagcgggcggcatcttatggatgtattggatgaactggaagaaatataagaaaaaatataaaacagttgtaagagtctttactgagatatacaaaattgataaaaattatgctctgtttggcgatggcaatagtgcttactgtttgttatgtaatgccaagtcaggcagcgaatgagtcaaaaaatacagaaactgcagatacaaatgaagatcttgatacacatgttgatgatggagtgccaggaattatggaagaagatgattttgatactccggagaaatatagaaagtatttagaggagcatcctgaacagcaagttgagacttatgctgcaaaagcgtccgctaatcataatgtaaaagcaacagcaacgttacgttacaaaattcaaaatttaccatcaaaaaatgccatacagaagacttatataggttctacttatatttatgttatacaaagagtaggagccaattcattgttatctaggtgtacgataaatgggaattttgggaaaagcacagaaacagaaggcatccagttaaaagggaatctggtctatttcggtatttgtgataagagtaaggcagaccctgcatgcatatactcaattaataaaagtgctttttaaacaaactaaacaaaaaattttaagaatgtggaggaataaataatgattagaaaaaagttttatagtattttcatgagcctagtgctattattttcaatgctttcttatacaccaatggttagtgtaaaagcgtctcaattaaggtatggagattatacatatcagattcagacaaatggtagtaaagaaaagtacatttatattacgggatatagtggaaaaggagtaaatattgtattgccaagtcaaattaataatataaaagtaacgactatttcagaagacttatttaaaaacaatgatttggtgaaaagtataacattatcaaaaaatataaaagatgtgtatggcagatattttaaagagatcaatcatttagaggagttaaaagcagtaaaagagaatccatattatacttcttcagatggagttttatttgataaaaacaaacgtgagttggtctgctatccaagagcaaaaacaaacaagaactattcgattccgtcaacagtaaaagaaatacaatcagatgcctttgcaaataactcaagtttagaaaaaattgtttgcaataaattaatggatgctattccagatgattttgcagcagaaagtaatattaaaacaatcgaaatgggcaagaatattcaaagaattggagaaagggccttttataaatgtaaaaaacttaaagcagtaaatttgagtaaaggtttaaaatatatagatgatgaggcttttcgtgaatgtacggctcttaccagcataaaacttccatccaagttaaaaaatattagattttgggcgtttaggaactgtaaattactaaagaaaatcacaattccggacagtgttacatttatagagacatgtgcatttgaaggatgtcctgcgaaattaaaaaaaccatcgtatttaaagaaaaataaattggaacttgggggatatgagtacagagcaatcgcagcggtgaaaattccaagaaaggggaaagacaaaaaagtaaaatatagagcttccaaaatcacaaaaattacaactttaaaaaagaacataaaattaaaaaagggaaagaagaaaaaaatttatacgaggatctatgtctctaaaaagaagaaacagggctatttagattattctattttaaaatttacttcttcaaataagaaagttgtcaaggtaagtaagtacggaaatatcaaggcgctgaaaaaagggaaagccactattacagtgaaactcagaacttccggaaagtcttatagaattaaggtgagggtaacaaagtaagcttataaaggcaaataagggcttctttgtcatcggcataagagataaccgtgacaagaaacttgttattttcttgtttttattcctgagggatcaggaaaagcaaatccggccacggcagtgtttgtcagaaaaaaacaaagtgtggagactaagtaattattacagtgagtaaataaaacttaaagctttcatagtccataaaagaaagcactattctttgtaattcgccaatatgggaatacactttcaaagaatagtgcttttttatgaaacttttcgtctataattctcctctggcctcacgatcaagcaattctttcataatagaatcatatcgtttatccaacttgtaaaatgcaagcgtaacgactgcaagggctgcgacgagtaccgggccgatcttgtaaatgttgatgatcatattcagtgcggaacctggctgtgtcacggaaccggcagcagaactgacatagcctgacagagagagcagtccggtcatggcggcggatgccacacctgcgcctacctttgttccgatggaaccgcctgcgaagatcagactttcctggcggacatgggttttccactgtccgaattccactacgtcaccgaccattccaaatacagctgcgttcaatggggccaggcctatagcgcgggttacacagctcatgactatccatggaaaactgtacggattcaggaaaaacagaagctgtcctgccagtgcgataaatgctccggcaaatgcaacatttctcttgccgaatttcccgatcagcggggcgcatgcaaagatacagcctactaaagtcagagtctctgtcataaacaatgcactgtacatccaggtatcattgtggaaaatatatttacaatagtaaggaagaattgtccctgagataccgaaggatacactctgaagcatccagagcacaagtactgcccagaaatactggtttgttacaagggctttcaggccttctttcagaggaacgcttttcactttttcttttgccgcaatgacaacggtttctttacatttcagaaaacagttgatgagcagtatcaatgcaagaactgcccagatggacatggtctttacccacgcggcctgatcgtctccgaaaagctttactaatgggagagtaaaagttacggctacgatacgtccgattggagatagtcccatcctcacaatactcaacatatccctctcggaagaaattctcgtcatcatggcagagagacttccgtaaggaagattgatggctgtataacagattgtggtacagaagttatatgtaacaaacaggtaaactgcctgaacgattccggtcgtgtgaggcacggtgaaaagaaggacggcggagagcgcatatggtatgctcatccaaagaatccacggccttgactttccccattttgagtttgtgcgctctacgataatacccatgaccaggtcagataccccgtcaaacagccgggaaagaagcataaccagtccgacagtagccggattgatcccaacataatccgtataaaaaagtgtgagtaatgtaccgatcattccaaagatcacgttacatgccacgtcgccgccggcataagagatccgggttccccagcttaatttgtggcccttgacatagtttttttccatttatttttctccttatttcatctggtatatcgaaaaaattcctatttataccgtgatttcagaaatttttacagggcggtgttcttccagtgactttttagccgcaagccccatgagtaccggctcaagtccgtccataactccgagtggtgtttctgtgtctttttcgatggcatcgataaagcatttgatttcttttgcgtaagctgccatgtagcgctccaggaagaagtaaagaggtttttctccggttactccttctgcattgctgatgaccgctgaagatgcggagtcattcgctgttgcgaccattccttttgagccgaatacttcagctctctgatcatagccgtaaactgcttttctggagttgtcgatgactgcgatcgcaccgtttttcatttttaaggtaatgactgcggtgtctacatctcctgcttcgccgatggccggatctaccaggacagctgcctcgacgtaaacttcttccgcatcgcatcctgcgaggaaacgtaccatgtcaaagtcatggattgtcatgtctaagaacattcctccggatacctttacatattctgcactcggcggttccggatctctggatgtcactttaatgatctgtgtctcaccgatctttccggcagcaactgcatctctgaccgcttcaaagttgtggtcaaaccggcggttgaagccaacctggtatttcacactgctgttttttaaagcatcaattacttcctgaatcttctttacgtcatgatcgatcggtttttcacagaagacatgttttcctgccttgatagcttccacggagatcggagaatgtgtatctgtggaagaacagatcagcactgcatcaatttcagaatcattcaagatatctttgtaatccttggttgttttttcaacgcccatctcttttgcccatactgctgtttcctctgtcataaaaggatctgcaagtgatttaacctttgcgttgccaacctgtgtacagatgctttctacatgtactcttccgattcttcctgccccgataatacctacatttaccataataaaaacttcctttcttatattgaacttgtttgatttctctatgagttaatcatatcaggacaaagatataaccaaaacctgtactatttttggatttgatagtatttttatgtgaaaattatgggagagttctttttgtgtcttttttttagaacaaaaaacaaaaaagaaatccgcattacacgatgcggattcctttttattcgttatgttaagttaaaattcggctatctgccggatcgcatcctcagaaaggatggtttgaaaatgttcattaaataaagccttagtcgcataagtatttgggatacgtttgctgtactctgaaagtctgctgcggactttcgtaaaatcatacttgttgtcctcggcagacaggcagagataataacaattattttcggtatctttatataagcggctttcatgcggaaagctaagcaccagttttgctgcattagctacttcttccagagaagaaaagcagtatacgtcacaattggaatccattatggccaggtgcactgcatcagccagttcggacagatcgctgtcagaagcatcgtcaaggaaattgagaactccgtcggaatcttccagattcatattgccggatgaaagctttgagttgactaatttctcgtaacggtcgttaaactgatcggcgtcttccactttcgtgacgacgaggatcagacattcctgggagaccgggatcgcttctaccataagaggaatgttattggtctcaaaacctaattcctgagaagctttcttcatcagttcgcggaacagtcctttggccttatcggaaccaaatgccagttcattgagcagtgtctcttttccagcaaggtcagctttattcaaagtacatcggatttgattgtcactaattcgttctatcttcatagtcatcactcccttactttatattatagtatagtatctgaatgcatatgtgtaaagtgtttctgaacaacttacaaaaatatacagaaatacttgaaattatttacagaatttgatattataaacttacagcatatggaaaagagctctttcctgcgctgaggcgccgcatcttcactgccttttcggcagtgtcttaaatttatatatcatagcacttttctggctcatttcacaaacatttcagaatggagattatcatgggacatcgcagtgatttattggattatttagaacttggattggcagtccaggtcgatggaatacccgtagacaacagcaatcaggaacaaatggatcttatgcttgaggaagatgattcctacatgaaagacttcattgatgatgagaaaggggagatctgtgccgtctactatcaaaaagtaaccaatcattaaacaatgcgtcatctataccagtagtatctcaattaagccaagggattatttctcttggcttaaataggattgaattcccttatagatggcctgtgctgctttttcctgataggctttatcctcaagtttctgcttttcttcttcattgcttaaaaaaccgcactctgcgatgacagtcacataaggattatcccgaagaaggaagtaatcgctgtttgcttttgccactctgtggttgtctggatccaaattttccaccagagaactttgcacgcagtcggcaagctgttttcctttttgagaaccctgatagtaaaatacctgtgcaccgtgcacttcaccgctgggatagctgttctgatgaacactcaccacaaggaccggctcggcatcaaagatgatctgcttcctgttggagagatcggaaacttttacattggtcgtgctggtggccagattgtagtcgccgtccctggtcatttttaccttgaatttttttttctccaggatcgtttttaatttttttgatatggccagattgatgtctttttccagcacatctccgctgccgactttgccgggatcattgccgccgtgtccgggatcgatgatgatgacattctgtttcccaatcgtctggtttacaaagatgggaagggtgatcgaggaaatatagagcaggacgatgatacagaagattgcaccccctaaaagttgtttgcgatatttcatttggagacctcaggacttttgtaatattatattcagaagaaggcctgatatatgaatgagtttttttaccattatttctgtcacgttttaaaatgcgttcctccaatagtggtaaaaactatcgtttaaaatcggaacgtcccaggtattcgctggtcatttttacgacttggtccgacagcagtgtgatggagatcagattcggtatggccatcaagccgttaaaggtatccgagaggttccagacaaaggacaggtgcaggatggagcctaaaaatataaaataaagaaagacaagtttataatttgtgacggctttttttccaaataaataggcagccgccgtctcgccgtaaaaggaccagccgatgagggtggcaaatgcgaagaatacgatggcgatggatacgaaggcagagccccaggagccgaagactgtggagaaggcagcgctggtcagggggactccattgggcagtgaatcaaaatggattgtagtgccctgggccgcgtccagagccatggcttttagataagttccctcgtcatagacgccggaagtgaggatggtaagggctgtgatcgtacacatcacaacggtgtcggtaaatacttcaaagataccccacatgccctggactacgggttcttttgcatcggaatttgtatgtacggtgacggaacttcccaatcctgcctcattggagaagactccgcgggagattccctttttcatggcaatggtgatcccgtagccaaggacgcctcctccggcggcttttggtgagaaagcaccgtgaaggatcgaatggatggtagatggaagccggtctatgtggacaaaaataataacaatacagcccagtgtgaataaagcagccattaccgggatgattttttctgtcacgccggcgatccgtttgattcctcccattatgacaaaacctaccatgaacagggtgacaagacctgtgattactggggagattgaaaaagcagaagagagtgcggatgccatagagtttgcctgtgtcatgtttccgatcccgagagaagcgagaaggcagaatgctgcaaacagagcggccagccattttgcgccgagaccccgttccatatagaccatggcacctccggcccatttcccgtttttgtcccggtaacggtatttcattccgagtgtgatttccgcataatgtgtcatcattcccaggatggaagaaatccacatccagaagatggctccgggccctccggcagtgatggcagtggcaaccccggcgatatttccggttcccagggtcccggccagggcagtgcagagagactgaaactgcgagatagaagcggaatcttttgtttttcttacctcggattttttcaaagaggacaagagcgtggaagaaatccacaatcgaaaatgtcttaactggaagcattttgttctaagcgtaaacatcagaccgacacctaaaaaacaggccagcataggagttccccagataaaggaattgaatgcattattcagacggctgatcagagtaaatatttgaaccatatatcaaacctctttgtgataattaaagtattatattcagccaagcagcaggtttatgatttatggcggaaaactccttgctttatttttcagcaaaagtttgttataataattattaataggtttttctcagaagaaggatgggttttatgaagacaattgtgagaaacgttgagaacaaggacaataaggaagcgatccgggaagctgccgggcttcttcgggaggggaagctggtagcttttcccacggagacagtctatggacttggaggcagtggctggatggaagaggctgcttccaaaatctacgaggcaaaagggagaccgtctgacaatcctctcatcctacatatcgggagcatggagatgatcgatgagatcgcatcctgcgtaccggggccggccaaaaaagcgatggaagttttctggccgggtccgctgaccgtgatcctgcccaaaagcgacagggttccgtaccgggttaccgggggactcgattccgtagccgtccggatgcccagtcatcctgcggcattggccctgctgagagagacgggtgttcctgtggccgcgcccagcgccaacacttcgggaaggcccagtccgacaaaggcggaacatgtggtagaagacctggacgggaagatcccgatggtattggacggtgggaaagtagaggtcggtgtcgaatcgacgatcgttgattttaccggagaagtaccggtcattttaaggccgggaaagattacaaaagatgaactcgagaagactcttttgacagaggtgctgatgagcactccgtcagtcaaagaggatacagtgcccaaggcacccggaatgaagtacaagcattatgcgccgaaagctcagctgattcttatccttggggaggacatagagaaagttgtaaaggagatcaccaaaagggtccatgactgccgggagcagggcatgaagaccggagttatcgccactgaagagacaatgggcgattacgatgcagatgaggtgatctctgtgggaagccgcagccatatggagacagtgacggcaaacctctatgacgtgctgagagagtttgaccacatagacgtggacgtgatcttttcagaaggatttgaaggtgaagagtatgaagaagcggtgatgaaccgtctggctaaagcagcgggacatcaggtgatccgtgtttaaaaggagattagtttgaaaaaaattatatttgtaagtacgaacaacacctgccgcagttttattgcggaatcggtgctgcggaaatatttaaaagacgcccacagaagagacatccaggtggagtccaagggacttgtcgtattatttccggagccggtacacacaaaagcagcagatctggtcaggaagagcgggattgagatcgtagatttcaaagcatcccagcttacgcaggaagatgtggagactagtgatctgattctcactatgaatgataagcagaaggaaaaagtactggaagactatcatggatataaggaagtggccaccatcaacgagtatgccaaccatgagggggcggtcattgatccttacgggatggatgacgaagactatgaacattgctttgtacagattacacaattaatccataaaatctggaaccataagttaggaggaaatgaaatgataggtattggatgcgaccacggcgggtatgcgctgaaacaggcggttattaagcacctggaggaaaaggggcacgcggtaaaagactacggatgctactcagaggaatcttgtgattacccggtatacgcgaaagcagtggctgagggtatactgaaggacgaagtgaaacaggggattctgatctgcggaacaggcatcggcatttccatcactgccaataagatcaaaggcatccgggcagcgctgtgcgcagatacattcagcgcaagagccacaagagaacataacaacgccaacattctggcgctgggggcaagagttaccggagaaggcctggcactggatatcgtggacacatttttggagacaaagttttctaacgatgagcgtcatatccgcaggatcaatatgatcgaggattaaattttcaggagatattatacggcatggacagcacgcgcggcttctgtgccgtatgcttttttgttcagaaaacaagaaagagaataaataccagataaatatggaaataatagctactgtacgaagcttttttcctagccataatatgttttggatgatataattacaaagtgtggatagaaactttttcaaggaggtctttatgaagatcaataaggacattgtccgctcattatctttgataacacagctgggaatcacgattctgacatcgacatttctgtgcatgtttttaggcctttggctggaccgaaagttttctacccatttttttatcccgttattgattctgggcattggaggaggactaagcggtgcctggaaactcataaggaatgtcagtgaagacgaggagggtgatgataatagaagagcttaaagagatcaatcctgtcctcttggaattgctggccggattggggatctacggtgcggcggccggtgcagccggcatggtcacatcagggggatctctgtattttctgggagggatccttgcggggctgtttcttgcggcctgtctgatcctgaatatgtatctgaccattgatactgcactggatctggatcctgaatctgcaaataagtatatggtaaggcggactctggtccgcaagttcctgactgtccttgcggcagccgttgggattaagatccatatgctgacattttcagggatcatacttggagttttggggattaagatagcggcatatctgcagccattgatccaccgccgtgtatcggaaaaacgatccggcaggaacgaagaagtaaaaagtagaatggattaaaaaggagggaatgctatgggaatgattcaggcccccatgttggctgccgcatcgggaaatgatgtggacttcatggtgcacgggctgataccattgaattttttcgggcataaggtatggatcaccaccacacatgtgacaacactgatcgtgatgctctttatcatggcgctggccctgatcgcgaggcggagtatcatgaaagattatgaaaagcccagcggtcttgccaatgcagtggaactggtggtggaaatgctggataagctggtgaagagcaccatgggaaaacactggaagccgtttgccaactatatcggaagcatcatgtttttcatctttattgccaacacatcggggctttttgggctccgggcgccgacggccgattatgggactactttgtctctggcactgatcacctttgtgatgatccagtacagcgcatttaagacgaggaagttccgcatgtttacggacctgtttcagccgattccggtgctgtttccggtcaatgtcatcggtgagtttgcaactccggtgtcgctgtcgctgcgtctgttcggaaacatcatggcagggaccatcatgctttcgctgtggtacggcctgcttccgatctttgcgaagctgggacttccggcatttctgcatgtatattttgacttgttttccggtgcgatccagacctttgtctttgccatgctgaccatgacatttatcgcagacaagaggaacgcgtaaaccggaagaaactatcaagagcaataaaaagaataattttatttttaggaggattttcttatgaatatttcaagtgaagcatttgtattaggttgttcagcaatcggagcgggccttgcgctgatcgcaggtatcggacctggtgtgggacagggatacgcagcaggacagggtgcggcagccgtaggacgcaatccgggcgccaagggagacatcatgtctacgatgcttcttggacaggcagttgcagagaccacaggtctttatggtttggttatcggcctgattctgttatacgctaacccgttattcgctaaattataatccgggaaataaaacggcggcagaagccgtcgggaaatgacaaaccggagagaattcagggaaaggaggacaggacgtggacagaatctttggacttgatatccagcttggatttgacgttttatgccaggcaatcgcggtttttatcatgtttgcttttttatcttatgtattgtttgaaccggtcaggaagcttttaaatgaccgtaaaaataaaatcgcacatgatctggatactgcggcggccgacaaagaagaggcggccagactgaaagctgagtatgaagaaaagatcagggatatagaaaaagaagccgatgagattttaagccaggccagaaagaaagccctgaaaagggaagaggagatcgtttcgggagccagacaggaagcactgaggatcacagagcgggcggaaaatgagatcgagctggaaaagaaaaaggtccgggatcaggtgaaacaggaaatgatccaggtggcagtggctatggcaggcaagatcattacagacaagatcgatccggcaaagcaggatgcccttgtggaagagaccttaaaggagatgggtgatcagacatggcgaagctagtcagcaaaacatatggagatgcctatctttcgctggcagaggagaaaggaaatcttgactctgtcaaagaagaagtccttaatgtgcgccgggtgtttttggagagcggggagctgaatcagatgctttcccaccccaagatcgtaaaagaagaaaaaatgcggatcctggagacagcatttaaaggcaggatttctgaggacatgatgggctttttgttggtcattgtgaaaaaagaccgataccgtgacataatgtctgttctcgactatatgatcggccggatgaagaagaaagaggggatagggagccttcaggttgcctccgcttttgaactgtccgaagggcagaaaaaggacattgtggatcgaatgaaagaactgacagattacagggagtttgaagtggactatgagatagacgaggggctgatcggagggctggtgctgcggctcgacgacagggtcatcgacagttccataaggacgaagcttcagaccatgggaaagagtctgtcaaaaatacagttgtgattataggcaaggaggcaaaaaagcaaaatgaatttaaggccagaagagatcagttctgtcattaaagagcagatcaaacaatactctaccaagcttgaaacctctgatattggaaccgtgattcaggtagccgacggaattgcaagaatccatggtcttgatgaggccatgcagggagaacttttagaattcccgggggaagtatacggaatggtgctgaaccttgaggaagacaacgtcggagccgtactgctgggagatcagaaaaacatcagtgaaggggatgtcgtaaagacgaccggaagagtcgtggaagtgccggtaggtgacgcgatgaccggacgtgttgtgaattctctgggacagccgattgacggaaaaggtccgatcgagacagaaaagtaccgtccaatagaaagagttgcatcaggagttatctcaagaaaatccgtagatactccgcttcagacaggaatcaaagcgatcgatgccatggtgccgatcggacgcgggcagagggagctgatcatcggcgatcggcagaccggaaagactgccatcgcggttgatacaattattaatcagaaaggtgagggggttcactgtatttatgtagccatcggacagaagtcgtcgaccgtagccaatatcgtaaagacactggaagagtacggagccatggattacaccacagtggtggcatctaccgcaagtgagctggcaccactccagtatatcgccccatacgcaggatgtgccatcggggaagagtggatggagaaaggggaagatgttcttgtcatctatgatgacttgagcaagcatgccaccgcataccgtaccctgtccctgctgcttcggagaccgccgggacgggaggcttatccgggagacgtcttttatcttcactcaaggcttctggaacgggcagccaagttatccgatgaactgggaggaggttctctgacagcccttccgctcattgagacccaggcaggagatgtatctgcctatatttcgaccaacgttatttccatcacggacggacagatttacctggagaccgagatgttcaatgcgggattccgtcctgcgatcaatgcggggctttctgtatccagggtaggcggtgcggcacagattaaagcgatgaaaaagattgcaggcccgatccgtactgaccttgcacagtacagggagctcgcagcctttgcacagttcggttcagaactcgatgatgacaccaaagaacgtctggcacagggtgagaggatcaaggaagtgctcaagcagcctcagtatcagccgcttccggtagaacagcaggtggttattatctatgcggctaccagaaaatatcttttggagattaaggttgaagatatcctggacttccagaaggagctgtttgaattgatcgacaccaagtatccggatgtgttccgttcgatccgggagacaaaggagcttggaaaagaagcggaagacatgctgatcactgcgatcaaagagtgcaggcagcagtttgaagcaaagtaaagaggtgagcttttatggcatcaattgttgatataaaaagaagaaaagccagtatcgagagcaccggacagattacaaaggcgatgaagcttgtctcaacggtaaagcttcagagagcaagggtgagggccgaggaatccaggacttacttcaacaagatgtaccggaccgtatcttcgatcctggcccagtcagataatatcgaccacccgtatttaaagtccaatggttcggaaaagaaagcagtgatcgctgtttcctccaaccggggactggccggagggtacaataacaatattgtcaagatgatccgtgacagcggactcaacagggaagatgtgatgatctacggagtcggacataaggctatggacagtctggcaaacaggggatatcatatcgtctccgatgactctgaaatgatcgacgaaccggagtatgaagacgccgttgatctgggaaaccgtgtcctcaaggcctttaaggacggtgaaatcggtgagatatatctggcatataccaattttaaaaatacggtagttcatgagcccacgatgatcaaactgcttcctgtggagatcgatccaaaggaaaaggaaggggaagactccaaaacactcatgaactatgagccggaaccggaagaagctttatccatgctgattcccaagtacgtctgcagtctgatcttcggtgcgcttgttacatcggttgccagcgaaaacggtgccaggatgcaggccatggattcggcaacgaccaatgccgaagaattaattgacaacttaagccttgcctataaccgggcaagacagggcgctatcacgcaggaattgacagaaatcatttcaggagcggaggcgctggaatagaagtaggaggaattattaaatggcagataatcatacagggaagatcacccagattattggtgcggttttagatatcaagttcagtgacgggcatctgccggagatcaatgacgctattgatattatgacaaagcagggcgggaagctggttgtagaggtttcccagcatctgggcgatgacaccgtgagatgtattgcgatgggaccgacagacggtctggttcgagggatggaggcggtctgcacaggcgggccgatctctgttccggtaggagagcagaccctgggaagaatgtttaatgtccttggagatcctattgacaataaaccggcccctgagaatgcaaaacgacagccgatccacagaaaggcgccggctttcaaggaccagtctacagagactgaggtcctggagacaggcatcaaggtcgtagaccttttatgcccgtaccagaaaggcggaaagatcggactgttcggcggtgccggcgtaggaaagacggtcctgattcaggaattgatccgaaacattgcgacagagcacggcggatattctgttttcaccggagtcggagaacgtacaagagagggcaacgacctttaccatgaaatgagtgagtcaggagtcatcgacaaaactgccatggtattcggacagatgaatgagccgccgggagcgcgtatgcgggtcggccttacaggattgactatcgcagaaaacttccgtgacgagggtggaaaagatgtccttttatttatcgacaatattttccgtttcacccaggcaggctccgaggtgtcagcacttcttgggcgtatgccgagtgcggttggatatcagccgactctccagacagagatgggcgctctccaggagcggatcacttcgaccaaagacggttctatcacatccgtacaggcagtctatgtgccggccgatgacttgaccgacccggctccggcgacaacctttgcccatctggatgccacaaccgtactttcccgtgccatcgtggaacagggaatttacccggcagtggaccctctggagtccacatccaggattctggacccgaagatcgtcggggaagaacactatcaggtggccagaggggtgcaggagatccttcagagatacaaagagctccaggatatcatcgcaatcctcggtatggatgagctttctgatgaagaaaagctgatcgtagaccgggcaagaaagattcagcggttcctgtcccagccgttcttcgtggcagaacagtttacgggtacggttggaaaatatgtaaccttaaatgatacgatccagggcttcaaagaaatattagacggcaggcatgatgacattccggagggaatgttcctgaatgcgggaagtattgatgaggttgtggaacgtgcgaaagcaaagtaggcaggtgatcctatggctgaaaatctgatgaaactggaagtgaccactccggaccgctctttttatgcgggagtggtccggatggctgagtttacgaccacagaaggggatgtgggaatctatccgaaacatatcccaatgacaatgattatagctcccggcatcctgaccatcacggaggcagacggaacgaagaaacaggcggctctgatgaaaggatttgtggagatcaccaaggaggctgtcaacattttagcagaggttgcggaatggccgggtgagattgacttagagcgggtggagcgtgccaagagacgtgcccaggaacgcctgaaacacaagagtgatacagacctcaccagggcggaaatgtctttaaggagagctctggtaagagaagaattatcaaaaaggatgtagacagaacatatttctggacgggcagccatgagagccgcgttcagaaatatgttttttcggttttatggaaaggggctgtaaagatatgaagagaatatatcaaaggcttggaccggcaatgatactggatgggtctgtcatactgagaaggttcatctgtttgccaagttgttattctgataccggggatctaaagttacttcgtcttcaaaccactcaggcccctcgtaatccagagcggcttcttcggacgcaaattcaacttcagccatcatgagaccttcgtggtcaccgtggaatacatccagttcgatggtgagagagtctgagtcaggaatctggtagcgtgtcttatagatgagaataccgtcgatcttgcttttcaggtgctcataagcctgcttcgtcagaggaaattcatgctcggcccgtttcatcagacctttagacttataggtcaggatgtaatcatggtcgagtctgcggatccggatcaccggttccatgcacagatatccctgctcgatttcggagtggggataggaatcaaggtctttcggcgggtcggtaacaataaacttgcgttctatttccatagtgcgttcctcctttttcctcattatatacgcagcggagacagaatgcaaaggaaattgacaacggggcggaaagcttttaaaatgttttagaaacatgaatacagagaaggcgaggaagatacaatgcgtttaaggaatgtgccgggagcggcggacatgatagcggccagtccgttttcagtcaatcaaccggaagaatggaaaggcaagtggagggaactgtttggcaatgacaggccggttcatatagagatcggtatggggaaaggaaaatttcttttgacattggcggaaaagaatcccgaaatcaactatatcgggatcgaaaagttttccagtgttctcgtgagagcagtagaaaaaacggaagagtttgaggggaataacttgagactgatgcgcatggacgcggagaatcttcaggatgtatttgccgagggagagatcgaccggatctatctgaatttctccgatccgtggccgaaagaacgtcacgcaaagcggaggcttacgtctacgagattttatgagaggtatgaccacatccttgcgaaggacgggcaggttattttcaaaacggataaccgggggctgttcgacttttccatggaacagacagaggaagccggatggaagctccttgactgcacgttcgatctgcatcacagtgagtttgccaaagacaatgtcatgacagaatatgagacaaaattttctgaaaaaggcaagccgatctgccgtttcacagcctgccgttaatatttttatccgtgttgcatactataataaaaaagtggtaagataattatgaaacagaaaaagtgtctagtaaaggtaaatcaattcttctaccagcatccaaagcacaggaaatggttctgccgcctgctggcatcgctggaagaagcaaaagattgtttatgccggtcaagataaggagaatgaatatggagtatacgtttacgaaggaaaatttccaggcagaagtgttagactcagagcagccggtacttgtcgatatgtttgcaacgtggtgcggaccgtgcaggatgatggggccggttgtggaagaactggcaaaggagtacgagggaagcgttaaagtcggaaagctggatatcgatgagaacagtgatatcgcagggcagtacggcgtaatgtcagtacctactttcctggtctttaagaacggccaggtggcagcaaaggttgtaggagctgtgcctaaagaagaattaaaggaagccgtggataaagcacgctagagactaagaaatgaacgaataaaaacggatggacggaacgtaaaccggccatccgtttttctgtgggtctgccccggggatttcgtttgacaatatgaaagacagcaattaaactaaaaaacagatagtcaatgaagaaaaggtggacccatgaatatattaaacatagaacatataagtaagatttttggagataagaccatatttgatgacgtctctttaggagtgcatcagggagataagatcggagtgctgggcgtcaacgggacagggaaatcaactttattaaagatcattgcaggaatggaaacggctgacgagggagaggtgatcttcggcagaggtatccgaacggctttcctcccacagaacccggagtttccggacggggcaaaggtgctgtcctatgtgacggaagggaaacatgatccggacgggggtgagccggtgagcgaggccaagacgatccttacaaagcttgggatctgtgattttgaggagactgtagatcacctgtccggcgggcagaaaaaaagagtggcgctggcccggactcttgtggacccggcagatgtactgattctggacgagccaaccaaccatatagacaacgatatggccctgtggctggaagattatctgaaacggtttaaaggagtcctgatcatggtgacccacgaccgttattttctggaccgtgtaaccaataagatcgcagagattgacaagggaaaactgtacacctatgactccaactattcaggctttttggctttaaagacacagagagaagagatggagctggccgcggagcgcaaacgccggagtcttctgcggacggagctggaatgggtgaagcggggacctcagggcagagggaccaaacagaaggcaaggcttgaccggtatgaacagctgaaaaacatggaaggccccggggaagcccggaatgtagagatggattccgtcggaacgagactcggcaagaagaccattgaacttcatcggatttccaaggcatacggagagaaaaagctcataaaagactttacctatattattttaagggatgaccggctggggattatcgggccgaatggctgcggcaaatccacactgatgaaaatcatcacagggcgtctggtccctgattccggagaagttgtgaccggagacacggtaaagatcggatattttgcacaggaaaatgaagacatggaggatgacatccgggttatcgactatatccgggatgtggctgattatattcagacacccggcgggaagatcagcgcgtctcagatgctagaacgctttttattcacgccttccatgcagtacacacctctgtccaaactttcgggaggagaaaagaggaggctctatctgctcaaagttctgatggatgcaccgaatgtgctggtgctcgatgagcccaccaacgacctggacatagcgacattgagagtccttgaggattacctggattcttttcaggggattgttctgactgtgtcccatgaccgctattttctggaccgcatcgccggcaggatttttgcatttgagggcggcggtgaaataaagcagtatgagggcgggtatacagactacctgagagcagtaaaaccggcggagcagacaaagccgaaggaaaaaacagataagaaatcatggaaacagaaagataccagactgagattttcatataaagaacagagagaatatgaaaccatagatgaggacattgaacggctggaagaaaaaattgcatctgtgggacagcagatggaggaaaacgccagccagtatacgaagcttgcagaactgacagaagaaaagtcaaaactggaagaacagctgaacggaaagatggagcggtgggtttacttgaacgacctggcagaaaaaattcaagcccagaattcctgagaggtggatttggatgaagaagagtaaaaaacatagcaggataaaatctctgtatgaggttcttttgtgtgctttgctcgcgggaagtctgtttgcctgccaaaagcatgaatctgccgaggctgagaaccccaagtatgtgatcggcgtcgtgacaaaatcacggaacagtgaatattggatgtcagtctgttccggcatggaaaaagcggcttcagatctgggagcatcggtcattattctgtctccggatacggagacagatgagaaaacccagcagcagatgatcggcagccttctgaaaaaagatattgatgccctggcagtatctccgatcaattcccacaatgcaaaggactacttaaagaaggcggaagaaaaaggaatacaggttgtatcctttgacacaaagattcttgagagaggagttccctatattggaatagacaatgaaaaagtagggagagacctggctgaatatatggcgggccagatgaaaaagaaaggggttgcaggaattatatccggaaacctgaaacagagttcccatgcctcaaggatgaaaggctttaaggattatatagagaaaaatacagacataaagattgcctttaccgagagcggatacagcaatctgcggatgccggagaaagaaatctcaaggcttatgagagaacatccggagttgaatgggatttttgctacgagcgccgtgaccgcacttggaatcatggagtacatggaagaccgtccggtgctgattgccacagtggatgcccaggaggatgcgctcgatgcggttaagaagggaagaatcggggctttggcttatcagccgggctatgaaatcggctatgagacggtacgctatatcgtaaaccaaaaagaaggcaaaaagcagccggaacaaaaaatcattaaagtagatctaaaaataaaaccacaaaaataaaaaaagtacatacagctgaggacctttggcagaccaaaggtcctttactttcatatattatatggcagccggaatgcgttacaaaaatataatatcaaatctaaaaaatccatggatacgacttcggataccggaaggtaaaataaaaccaaaggcacagatcataggatatcacatcggaaagtctttggcagacgaaacatcataaaaaggagagaagtctatgcagattaccgtgaaatgctgaaaaaagcagatatcgatgcagttgccatagtgacgacgagcggagagcactgctggcagatcgaagccgctttggatgcgggaaagcatgttttttccgacaagccgctgggattaacggttgaggagtgcaggacagctgaggctgctgtggaacgccatccggaactgacatttttccttgggttcatgcgccgctatgatccgtcttatgcgtatgcaaaggaaaagatcaaagaaggggccatcggtacaccatatatggtgaaagcggcaggaatcgatccggaagctctggtagaaggagccattaaatttgcagcgaccagcggggggatcttcattgatatggcgatccatgacatcgatctgatgcgctggttcctggaatccgatcccgtggaagtatatgcggcaggagccacattcaaacatccggagtttaaggaagcgggagatgacgagaccggtgcggcaatgtataaatgcgaaaacggtgcactgggatttgtgcacgtcggacgtactgcggcacatggatatcacgttgagacagagattgtcggcaccgaaggctctttaaggatcagtccggtaccggaaaaaaatctgtgtatgatctatgataaaaacggggctgtgaaagaatgtgtcagcggttttccggagagatttgcagagtcttatcagctggaaatggcagaattcatcaactgtgtccagaaaggcgttaaaccggacgtcaccgtatacgacggcacaaaatcaacacagattggcttcgcaactacaaaagcctggaaaaagggaggcattgtaaagatcgaatattaaaaatcggtcagcttgacactctttgggtgtcacgtataattagaaatagaagaaaatatcagggaagggagagtgaggtctgatatgatacgcagtatgcggagtaaagttttcttagccatcatcagcatcacatttttgactgcctcggccatcaccctgatattttatttgaaatctactcagatgattgaggacaattacgggacaaacctctatggccgcattgagcaggtagggaatgctttcgatgatgccatgaaagagatctattacattacggtacaggcatccaacgcagaagggctttcccggcaggcagaaagctatctaaagacagaagatgcgggacggctggagaagatgtccggtatgctgggaggattcaagaaacgaaacagtgatatcggatcagtctatctggttcttccggaacagaaaaccattgttacgtcggaggattatccggtttatgtaaagaaagtaaataactctgtattaaagcatattgcagagatttctctggaggaccaccccgtcattatcaaagatccggtgagaaaacagaataaagtgctgtcttttatcgagcccgtcatgaaagacggaagtgtccttggctttatcatgtgcaatattgaagagcgggctgtctattataagtatctggatattctaaatgacggcagatcttcggaggcggtcctcctcaataagaaaaatgccattgtctctacgaagaatgtcgaatccatgggcaaaatttacaggaacagcaattttcccgatatccagcagaacggcatttttaataaaaggaccccggcggtcataggtatcagctataaaacggcatttaccgggtgcagtttttttattacggttgagaagagtgtcgtattgagtgacctgaatcagctgaaatattttttgctggcatttttatttctctttctgggcatctcactgattcccgcctattttgccacgagggctatgtatgagccgttaaggaatctgacggcggcgatggatgaaatcagcgccggagaactggataaaagggtccaggtctgcaccagggatgagattggacggctttccaatgattttaacaacatgctgaaccagattgaaaagctgattgaaaagctgatcaaggaagaaggactcaaaaaagacgcagagctggaagcacttcaataccagattaccccgcattttatgtacaatactttaaattccataaagtttgcggctctgctgaaaggagagaaggagctgggcggcctgatcggtgattttgtcgagcttctgcaggcaagtgtcaacaaaaaaggcacgttcgtcacggtctcagacgagatccatattttaaaaaattatattcatctgcagaaaataaggtatgacggttattttgatgtggattatgagatcgggaaagacgcgggcagctgttttgtcccgcggctgattctgcagcctctggtggaaaactctattttacatgggctggatatgaagatggacaacagccggatcgagatcagggccgtgatcgaagaagactatttatgtatcagcgtgaaagacaacggaagaggaatgacacaggaacagatttatgaactgctgaccaaaaaagacaaaaaaaccagcggcctgagcgggatcggggttgtcaatgtccgtgagaggctcgaactgtattacggaaacaatgccggtctgggctatgacagtaattccgacggaacaacggcatatctgtatctgccggcttataaagaccagaatcagtatgcagtgtgaaaggagaaaacgccatgtaccgaacaatgattgtcgatgacgattttttagtgcgcagttatctgaagcagctggatgcctgggagaaagcgggctatgagatcgctgcagatgtaagggatgcggaagaggctttaaatgcagtcagagagcaggctcccgacatgatcgtaaccgatatttccatgcccctgatggacggaatcgagctgatacgcagggtacgggaaatgggtctttctacatatatcatcgttctgagctgtcatgatgatttcaattatgtgaaagaggctatgcgccttggagcaaatgaatatgtactgaagaattctctggatgaggattctctttttgaggtgcttaaaaatgcggaacaccatatgaacagtataaagaaactaaacagtgaagaagaacggacaaaaaagctgatcgaggccggaagccagtccctgaagatccggttttttaacgagattttggcgggagatatgagtcccggggagcgggaagaaaggcgcattgaagccgggattaaaggaaaatatataaacagtgcggtcgtgaatatgtttatccctgcctggatgtcgatcaaagacagccagtcaccggcagagtcggaacaatatgcggcaggattcatagagcgtctgtccgctcagcttcagatgctcctgggagaggagcacagcagggccgagacagtttctctgggaggaggcatcttttgctgttttctggatctttctgatctgagcaggagcagtgtgatgaggcagaagctcacaagtgtggcctctgcctgcttcaaatgctgcaaggaggagatctttgactacgatattgcagtcagcaatatctgcatcggagagggcggcatccgccaggcataccagcaggcaagagaggccattaagcttagtttttatgaggacagcgatattttatattttgacagccagaagaccatcgggaccaagatgccggagtgtgcacaggagcttttaaatcatgcaagggattatgcggcaggaagaaaagaaaaagagatgaaagaagagttttttcgtgtgatagaagcatgccgggagacaaggacggacccaaagatcatttttcggtggattcggaaattagatacggccgtggggacagagcacagtcaggaagagctgtttaagcttactcatgtggatcagctttctgatatatttaagggttacagaagcaggatatttttaggtacagggaaaaaagttccggaaaatgcggggacacagacgagacaggcagtctggtatatccgcgaacatttcaaagagcagattggccttcaggaggttgcagatgccgtagggctgaattttgcttatctgagttatctgtttaagcaggaaatggggatcggcttttcgggatttcttctggaactccgtgtagagtatgcaaaagatcttctcaaaaatacaagctacaagattaaagatgttgcagtggaatcgggattcaacgattaccactatttctcaaaggcttttaagcggttaaatggggtcagcccggcagagtaccgcaggaagtcctaaaaataagacaccaaatcgggaacatctatttttagaacaacaaagctaaaaatattcccgattttttttgatctttttccatgttatcctttattcagataaaaaaagaacacggataaaggagaagtgctatgtttaacaaagaaaaagtaaaattaggaattgccccgatcgcatggacaaacgatgaccttccggatttgggaaaagaaaatacgtttgagcagtgtgtcagtgagatggctttggcgggatttaccggctcagaggtgggaaacaaatatccgaaagaccctgaagtgctgaaaaaagctttagagctgcgtggaattgaaatctgcaaccagtggttttcgtctttcctgattacgaaaccgtttgaagaagtggagaaagatttccgcgcacagctttccttcttaaaagctatgggagcaaaggtcatcggagcatccgaacagagccacagtgtacagggaatgactgacacgccgatcttcggacataaatatgtgatgaatgatgaagaatgggagatattctgcacgggtatgaataaactcggggagatcgcaaaagaagaatacggcatcagccttaccttccaccatcatatgggaaccgtggtgcaggacccggatgaggttgagcggatgatggcaaatacagatcctgaatatgtcagcctgttatttgacaccggacattttacatactgcggcgccgatcctctggagatggtgaaaacatatgtggaccgcatcaagcacgtgcacttaaaagatatccgtccggaaatcgtagaaaaagtaaaggcagagaacctgagcttcttagacggtgtgcgcatgggagcatttactgtgccgggagacggatgcatcgactttgatccgatcttcaaggtgctggaagacgcaggatatgagggatacatgcttgtggaagcggaacaggacccggcaaaggcgaatccgctggaatatgcgctaaaagcaaggaaatttattgcagagaaaaccggattataaaaataaaataatttataaaatactgctggatggcatccggcagtatttttttgcccacaatgtccgggagagctgtggtatggtttctaatatagaacatattgttgaaggaggggttatatattatgaaactttgggaaaatacagtacttactgaaaagggtatagcgctgcagaataaaatgtttgacgggcaaacgttaaaaattacaggggcaaaggccggagcaggagaggtgcctcctgtgaatctgaggcagcagacacagatcaccgacgaacggcaggaaattacactgcagccggtgcggacagaggacggtaaggccgtgatttctgtactgctggaaaatacggaggtgaaggaaagctatgaactgcatcaaataggattctatgcagaagaccctgatgaaggggaaatcttatactgcattgcgcagactactgagggaaagaaaattccatcagcggcagaaagtccgggattttctatcacatggaatttttgttttcagaattcagatacggcaccttttgaggtcgttttggactcggcgggactggtcggagttgagcagtatgagcttcattcaaaagcaatcgaacagattggaaagacagttgaggatcttggaagtctgacatcaaaagatatagcaggattgacagcggcaatcaatgagacaaagaatgaaatcagccgattacgtgaggagctaaatacaaaagcggctcagtcaggtctgaataatacaaatataaaaatgaaagatcttgtgagaagtcagatcttacaaagatccgatatcagtataccggcgggaggaacacctgagtatcaattcgcatacgatctgccgtcgggatataaggtcttaggtcttggaggctttgcatgcactaccagtaatctgtccgtattcaatgcatacgtggacgaagcaaacaggcgggtgagatgctacattagaaattatactgtttctactaattacaataatcagacagttaaattctatatctattatataagaaatatataggattatagaaataaaagaccccgcatgcctgcgaggtctttcaatgaaaagagaggattaaaatatatatgaaaaactatgtcttaagtatatcagctttatgtgcgaatacaatgtatagaaactaaacaattctaaacatcctataaacaaatattaaggaaaacttgtgattcttatgaaaggaacgggtgattactgatatattcttccatgatgtaagcagcacagccgacaatctgttcacatgggcgcttcctgtaatagtcttttgtgcgctcttccgggacgtaagattcctttttctgatcaagccccagcagctcgcggcatacgatggaaccgtttaattcttcaaatgagcgggcgagttcctgaatccgcttgtagtgctctgtctttgaggaacggtctatcggtgagtcgtatccatacaaaactcccgcagtgagaaacataccgcttacagagccgcacacttcccggagtcttcccatgcctccgccaaaagaagaactgagcttgagggcagtgctccggtctatgccgtacaggtctttgaaagccagaaaaactgactgagagcagttgtatccttctttaaataaattcatcgctttttgggcatattgactggaagtgagatcaatgttcataagggctccttttcttttgtgccggttcattcagttttcattttacaaaataaaaaaacaccatccccagccccaagtaagccaaaaatagtgttttaatacgcgatgaggggctcgaaccctcgacaccctgattaagagtcaggtgctctaccaactgagctaatcacgcttatttcatgatgcgctactttttcaacgcaagaattattatatatgatgttttccataattgcaagtaaaaaatgaaaatttttttgtatctttttgtcgatgtcaataataaatgtatttgtcatgcaaaagtcattgaaaagaccgggtgcaaaagacgccggaccctatacttttctgtgtctttgtgctagaataaagccaaaatttgtttgtggcctgaggataacagaaggagtgtaagaattgaaaaacaataaatttgaatccaataaaaaatattttaccatatcgatctattcgattgttgtaatccttatcgggtgtattatattccgcctggtcaataactgggcgtctacggtcgggattcttacagatctatggaatacgatcttcccgttttttattggctttctgatcgcatatgtgatgaatcctgtcgttaccttttttaacgaaaaagtcttttcctcattattcggtgaaaaacgaaaaagattatgccgtgcaggtgcgatcctcactacttatattatattagtcggagcacttacgatctgtctgatcttcatcgtgcctcagctctatgacagcatcaaagaactgtccagccagatcccggtgatctcagatcagatcatgggactgctggatcactacaaggaaagcggttccggagtattccctgccgagctgatggacacactggagaccaagagcctgccgaagctggtacagctttccaatcagatgctcacagaagccattccgatgctatataatttttcggtttcatttgtaaaatggctgtttaacctgttcattgctttcgtagtgtccatctatatgacggccgataagcagttattgaaaagtgcctgccgaaggcttatttttgcagtttttccttataacgcagcggttccggtcattcacggactgaaggagtgccataatatcttctccggatatatcatcggaaagtcgctggattccctcattatcggattcctctgttttttgcttatgagccttctaaacctgccgtatactgtgctgatcagcgttatcgtcggggtaaccaatatgattccttatttcggaccttttatcggagcagtgccgggtgcgtttatcctttttattgtaagcccatataaaacactgattttccttggaatgatcctggtgctgcagcagttcgacgggctggtgctgggaccgaagatcctcggcaattctacgggagtcaggccgatcctgatcctgttctctattacagtaggaggagcttatttcggacctttgggtatgtttttaggtgtaccgttttttgcagtggtccagtatctggtcaacaactgggtcaattacagattgtataaaaagaatctggatatcgagtaggaggcatatatatgaaatccattgctgccatggctcagtgcagagcttcacaagaaccggaaaaaaatctctgtaaggcagaacacttctgccgggaagccagggaaaagagagcctgttttatcatattcccggagtattttatgacctactatcctatggagagaagtgcctactatgaaaaagcccagcctctcgacgggccctttgtacagggaatgaaaagactggccgcagcacatgggcagtggattttatttggaatgaacgaaaagcccggcaggaattcagaagggaaatgttttaatacggcggtccttttagatgacaggggaactctccgctctgtttacagaaagactcatctttttgatgcattttcatggaaagaatcggacagtacgctgcccggagaagctctgcatgagccggaggatacaccgcttggaaaggcaggcctgggaacctgctatgatctcagatttccggaaccggccagggtacaggcactgaagggtgccgaggttctgatctatccttcagcctgggcagacgggccggataaatttatgcagtgggagacgctgcttcgagccagggccattgagaatacggtgtttactattggctgctgccattacagtgaagaacactatatgggcagaagcctcgccttcgatccctccggcagaaagcttgcagaaggaggagcaggagaggaactggttgtcctgtcggtagacactgaccggagagatgccattatacatcaggttccggtattgaaaaaacgccggacagatctttatgacataaggacaggaaaatgaaattcaatttggaaaaaatactaaataattcagcggcaaacggaaatactcttctgcattttgaatgccggagtgatatctgtgaacttttgctggaaacattggtcagtctctttaaagatgttggggctgtcctccagaatgaaggatactatgactatatgaccgtgaattcctatctgaaattatttgcggaattatccggttctgatgtcacaatggattctgcagtccacatcatgcagcttgataaatttctgcactgtaagataaaatttctgacaccttcccaaaagtaccgtgtttcagcggcgagggaaatcatcatggaccgggaaatcttattcctgcaggaacccgtccctgggacagacagagcttctgtgcagccaatgatacagtggatcgagtcgagcggtgatcaggggaaaaaggtcattaccacctctcagtctttaaaacatgtgtatatgcttccggggagacatttctttatggatgaggagtatgcggaagaactgcctgaaaatattttttctaaacaagaacaaagcgggcctgagatggcggaaaagattccggccaaaatgggtgataaaattctgctttttgatccggacgagatcgattatattgaaagcatgcagggaaaaaattatctgcatgtcagaaaggccagattccagtgttctatgactatggatgaactctgcagcaaattgaaaaaattcggttttttcaggagccaccgttcttacatcgtcaacatgcaaaaagtttcggaagtcatgaaatggaccaagaattcttattccctcaggatgaaaggaggggaagaggaaaatatccctctcagcaaaggaagagttgaagaattgaaggagtattatggattttaggggctcttttcatggccctatatctccgttcgtccttttttacttgtcaaaaccaggaaaatccaataaaatgtaagtattacgaggaggtatttacatgaatcaagactgcataacaatggaacatgtgggcatttcatttcagaagaaaatggcattggacgatgtgaatatccgggtatcggagggagaaatctttggatttttagggcccagcggagccggaaagacaacgacgatcaaattattgagcgcgcagcttcggcaggactgcggtcaaatttctgtcatgggaatggaaccgtttgaagatgtcagcaagctgtatcagaacattggaattttatccgacaacagcggcttgtatgaaaaaatgtcggtggaggaaaaccttaaaatattttctgagatttacaggcttccgaaaacaaggattccggaggtgcttgagcagcttcatttaacagaagacggaaagaaaaaggctgagaaactttccaggggaatgaaacagaggcttttgtttgccagggcgatcttacataaacctaagcttctgtttttggatgaacccacggccaatcttgatccatctacaagtgaggatgttcacgatattatcaaacagctgaacagggacggaactaccgtttttcttacgactcatgatatggaggaagcagatgaactctgcagcagagtggcattcttaaacgaaggggtcatcaaagaggtcggggtaccggaagaactgaagatcaaatatgcaaaagacagggtgaagatcctttacacagacggaactgtaaaagaaattccgaaggacaaaacggccatagcagaggaacttttaagtgcagacaaagaggttgtgacgatccattcagtggaacccgacttgaaaacgatattcttggacttgacggggagggaattagcatgaaattaagagcgagaataataaaagcactgatgaaaaaggatttcagaatgcttgcgggtaataaaaatactttttttattttactgcttccaattttattctgtgtcctttacacaaaggtgctgccgattggaaaagagacagggatgttataccctctgcttctctgtgaagtgctgaatctgatctgcgcgccgatctcactgctgagcatgatggtggcggaggaaaaagagaaaaataccctgcggactttgatcatgtccgatgtcagggctatggagtttctggccagcaagatgtttgttgtactcttattaatggaagtaatctctgtgacaaattatctgctggtgggacttgacatgaagttttttgcgggctatatgctcatctccactttggcttcgatcggtatcctgtttttaggcgcaactgtggggattttgtctgaaaatcagatgtcaacaggaacgatttccacaccgctgatgcttctgctgatgctgccgccgatatttgccgggatgaacagggtactggaaaagatagcattttgtcttccaacaaacgcctttatggagatcatgaacggagaataccgaaacaaagccgcctttctctccggagccaacatgaaacactatgcggtctgccttgtatggattgtcatcggcattgcagtgtttaatattgtctacaagaaaagaggggtagacagccaatagtttataatatgtttagaattgtttattttctatatattgtttttaaagggaaagttgctataatgaaaatatagtttttcatatatacttaatcctctcttttttaaaatgctctgccggtaacagagcacatattgtaagcaggttggtgccggaagatattccggcaccatttttatgagttttttaccactattcaatgatctttatatagaatttccggtttctgggcccgtcgaattcgcagaagtagatgtcctgccagattccaagtaccggttttccgtcagcgatgatgaccgtctgtgacgggccgacggtcgatgttttcaggtgggcattggagtttccttctgcgtggcggtaatttttgtcatgcagaggatataccttgtcaaacccgaagagcatatcgtggaccacatccgggtccgcattttcattgattgtaatccctgccgttgtgtgaggagaatggatgacggcgatgccgtctttgatccccgaaattctcaggtcctcttccaggaaggaagtgatttttatcatatcctcccgtccggtgtgatttaaatggtgttcaaaaaaagtctgtttcatctcactgctcctttcttttgctctcagtataccgcatcaggaaaggtgtgccaacttctgtcaggcctcattgttaagtcctgtgaaattatattgtattttttggaatttactgccgtatattcttgttctatgacaatatttgtgatattatgaataaggtttaacgataatattacaaaaatcttacgatagaatgagctgccggaggagaagagagttgaggagctataaaaaatatattacagtgtgggccatggcattgactatggcagcagcatctgtgccggtttcagcggcgccggcagagagcggcagcactgaagatattcagaaaaacataggacagaaagaatcatatcaggtcaggtttgacggagcaggcggcacggtgagggaggccgtgcgccagatcgaagcaggagaacttatttccgagccggagacgcctgtcaggaacggatatgtatttaagggctggagtgatcagagcggaggacagaccggatactggaatttcagtgccgatgagatgcctcggagagatctgatcctcacggctgtgtgggaaaaagaatatacgcttgaccgtccccatgtgactgtggcggtctctgcacaggcgaaggtgggagtaagagaatcttcgtcgcccagggctgtgtggaagtcaggggatgaacgcatcgccactgtggacagcagcggaaacgtaagaggaaaagcggcgggaaggacttatgtacaggccatagtgggcagccaggttgtgacagcaggcgtacaggtcacaaatccatatctgtcaaagagcagcgggactgtggcaaagaaccggactgcgaaaataccgatcaggggattgagttctaccagccgatcatctgtctcagtaagcggcagcagggcgaaagtttatattcaggataatcagctggtcatatacccgaaaaagagaggcattacctggttttatgtcaagatagacggaaaacagaagacctataaggcggaggtcacttcctataaggcggtcaaagctatcgcgaaggctaaaaaagcaaagggatgccgatacagccagccaaagagaatgaggaagggctattatgactgcagttctctgatctggcgctgctacaagccgtacggcatacatttcggaagccgttcttatgctccggtggcagcgagtgaagccaagtacatgaagcgtcataaaaaagtcgtatcttataagagggtgaaggcccaaaagcttctcccgggagatgtgatcttttattcctacacaagaaacgggcgataccggaacatttcccacgtggcattgtacataggaaacggcaggatcatccacgcggccaaccgcagagtaggcgttgtggaggcaaaatataaatacaccaaatgcattaaaatgattgctcgtccggctaaataaattttaagaaaagaatcggctttctttaaggaagaccggttctttttgtgttatactgataaaaataaggtttaggtgagggaagctgcatgaaaaaagtaatttctaatcttcttctggctgtgtgcatcgtggtctttttattcagcggatggaaactcgcggggtattatctggaatataaaaaggcagatgacgaatatgataagatagcacaggaagtggtcaaaacaaaaggaaaagaacgagtcattgattttgagaaactcaggaagatcaatccggataccatcggctgggtctatgccaggggaaccaatatcgattacccggtcgtccttgggaaggataacgattattatctgcacacaacatttgaggggacaaagaacagttccggagcagttttcatggactgccacggggataaggatttcggtgcggagcacaatatcatatacgggcatcatatgaggaacggatcgatgtttgcagaccttatgaagtttcgcgagcagagttttatcaagaaacaggatacgatcaccctttatactccgaatgggaaaagggacctgaaggtcgttgcctcttatgcaagaaaggccgacaagctgatcccgatcacttttggggacaggaaggacatgaagaagtatctggaggagattttgtccatgagtgatatccagtccaggataccgaagaagactgtgatgaaaacaaagaagctgtatacgtttgtcacgtgcagttatgaacaggaagataaccgtacatttgtacatgcgattgagagcaaagattaacgaggacttatatgttcaaatttacaaagaaaaataaaagggaacttgcagttatctgcacgtttctttttattgtcacttttatttttatatggatcatccaaaatatcggactgccgatcgagacaaaagtcgaaaacggccatatcaaggtgatcgatgtttcaaaatacaaccataaagtcaactggaagaaagtaaaggacagccagatcaaccacgctgttttaaagatcggctccggtgcgaaaaaaaagaaaaagggcacagaagatccgatgtttattgcaaactaccggaacgcaaagatctcatccattcactgcggagtttattattactcttatgccggggacgtgaaagcggcggtgaaagaggcaaaacactgtatttccctgttgaagaagcatgatattgacccggaagatctgaagcttcccgtggtatttgacatagaggaagaagaagtcatgaaaaccgggaaaaagaatgtgacggcgctgacaagggctttctgcgaagagatcaaacgggcgggctatgagcccatggtctattccaacgcttactttttaaaacactattttgactatgacggtattaaagaatataaaatgtgggtggctcattatacaaaagaggatgagccggatatcccatatcaataccacatgtggcagtttacggatcaggcttctgttcccggggcaaatacgggaagcggccactgcgatctgaattactatttaacagataaggaaggaaacctgttatgagagaaatcaaaaaagcagcattgataggccttggggccatcggcggattcgcggcacccgggctttgcaaagcgctcggcagcgagaatttctgcgtcatcgcaggaggagagcgcagaatgcgtctggaaagggacggcgtcatcatcaacggaaaacaatggaaattccagacggctgagccctcatgggagagcagaccggcggatcttattattttgagtgtgaagtatacggcgcttgaccaggccatcgaagatatccggaaccaggtaggggaacacactgtcatcatgtcactgctgaacggagtggagagtgaagagcggatcaaagcggcctaccccgacaatgaggtgctgtattccgtaatacgtgtaccggcccttcaccatggaaatgaaatctcttttccggtgggggccggcaagatttctttcggccaggcgtataacgatacattgtcggaaaccgtgtgttccgtgagggatgtatttgaaaagggcaaaattccatatgaagtgccaaaagatatgctgagaaatatgtggcataagtttatgacaaatgtaagcgagaatcagagcgctgctatccttcgtgtcccttacggcatctggaccatcagtgaagatgccaatgagctgagggagcaggcggccagggaagtcatcgctattgccgggaagaaaggtatccatctgacagaggaagatcttttggaacacaggacctattttgagagcgccccattctatgggaaaccttcgactcttcaggatatcgaggccggaaggaagacggaggtggagatgtttgcgggagcggtcataagaatgggaaaggagctgggtatcccaactccttataatcaaatgttttatcactgtatcaaaaccctggaaacctggaatgaccaccagccggatcacaaacaggatgacgcataggatacaaattccagcaatactgcatagccgaaactgatgatcaaagccgcatagtatgagataccggcggctttttcatttggccagctttgacggatatccctgtcaagccatgtcttcagataaccggaacggccgcacaggcgggaaatggcaatgaggatcagaacactcagcgccagaaaggcaatacttacaggaaccaggactgcgatggcctgaagcctctgggccgtggatacggtctgggtcatgagagaagaattgccgatcagtccatagatgatgctggttatgacgctgacgccgttaaatgtggcatggagcagcatacaggaataaatactgtcggaagcctctaaaagcagacctaagaccagtcccaggacaaaggcataactgaactggttgaaattcatgtgtgcgatgccgaaaaataatgcggtcagcaggattcctttgatagggcgtgcttttctgagaccggaataaataacgccccggaacagcacttcctctacgatccccggaagaatagacagtgccaggacggaaagccagggattctgcgaggccgtggatacactggaggtaataaagtcccggaaaatcagctggcttacattattgatcaggctgataaaaggcaggaccgtaaatgctaaaaggatagaaagcaatgcagcggccggtctcagaggtttcagatgaagtctcgctttcacatcttctttgccaatcttcagataaccgatgccaaggccaagaagtaccagataaaatacaatcataaacaaatatcggtcctgtactgcaaactgcagcagaggggaaacaaaaaagtagacaaacaaatacatcagacagaaacagcccggtgtcttaaaatatttcatataatatccagctccttgtaagtttattttgcccggatggttccgccggtgatctcgatcttattctgtttcagtaatcggccgacggctcgcttaaaggcatttttgctgagtcccagttctttgtcaatcatggcagggctcgccttgtcggtgaatgggagtaccccgtcatagcttttgatcgtttccatgaccagctcgctgtctgcatctatctgaagatatgctttatctctcggtgagagatccagtttgccgtcctcccggacgcggagtacccggacatttacagagtctcccacagacagtctggtgtggacttcgttgagcgggatcaggccgaaatactggtcgtctacggctacaaacgtaccgatctcagggttaatgctgtatacggtgcctgtgacccagtcatccttctcatagtcatgttcactgctcagtgcctgataaatcttcatggaagcacagagacgccggctcttgtcaatataaagcctgaccagataggaatgatccgttttgatcttggatgtctgttctttgaatgggaggaacaggtctttttccagtccccagtccaggaatgcaccgatatctgtgatctccttaaccttgaggacggccagatgtcccatcgtaatgagaggatgggaagtcgtagcgatcggacggtcttttgaatccttgtagacgaagacggaaatgcggtctccgacccgggctccctccggaacctgtttttttggcagaaggatactctgttccgtcacaccttcctcgtcatttaaatatgcgccgaaatcggcaaattttacaatataaagttcttggttttctcctaatttaatcatagttcttcctttctttgtttcattattatagcataaatcgcttttcatttgcagaaaatgtgataccataaaaagaaaacggagggagtcttaaaatgcaggaaaaagaatactatacaatagaagattttatccaggtagtaaaagaactgcggggagaaaacggatgcccgtgggacaggaagcagacacatgaatccctgatcccctgtctcgtggaggagagcggggaagtggtggaggccattgaacataatgatatgcagaatctggaagaggagcttggagacgttctccttcaggtggtgatgcatgcaaggatcgccgaggaacggggagatttcagtttttcggatgtggtgaacggagtgtgcaggaaaatgattcggaggcatcctcatgtgttcggagatgagacattttccactcgggaggaacaattatccagctggaggaagatcaaggaattagaaaagatagaaaagaagcgcaaagcccgtgaattggctgaaaataaggaataaagcgcattttggcttgacatgcaggcaccttaattatacaatgaactcatgtaatcgaagagcagaaaatgcttatgacgaaattaggaggaatataatcaatgaacaaaacagaattagttgcggctatcgcaagcaagactgaattatctaaaaaagatgcagaaaaagctttaaaagctttcacagatgtcattgcagaagaattaaagaagggtgagaaaattcagttagttggtttcggaacttttgaagtttctgagagagctgcaagagaaggaagaaatccaagaagcggtgaagtgatgaacattcctgcatccaaagctccaaagttcaaagccggaaaagctctgaaagatatcgtaaacgaaaaataatcacagaacgacaaatcaagctgcccttcaatttttataagggcggcttcttttatattatattacagggaagttctgcagatttctgttttgtttttcgaaaaccaacatcaaaggagtaatattgaatgagactagacaaatttcttaaagtatccaggctgatcaagcgccggaccgtcgccaatgaagcgtgcagcgccgggagagtgaccgtcaacggcaagaccgccaaagccgggacagacgtaaaaccgggggacgagatccgcatctcgttcggtaataaagaggcggccgtggaagtcctccgggtggaagacacagtaaaaaaagaccaggcggcagaattatacaaatacatttgatatttttcacatgattttcgttctcctttcatatagtgtataaactatgaaaggagattttttcatgatagaagatagacaacctatgaaaacacataaagtggatctgctgaaccgttctctgggtgtcattacgggagtgagggatgtagtgtccttcgacctgaatgagatcatactcgatacggagcagggactcctgatgatcaaggggtttaatctgcatgtgaaaaagcttttggtagaaaaaggcgaggtggagatagacggtaaagtcgacagtttcctatattcagatgtggatgaccataacggaggcaaaaaagaagggctgctcggaaggctgttaaaataatgcaggaagcagtgttaggccagctttatttcttcctgggggctgtctggttcggagcatgcctgctgcttgtctatgacggcatcaggagtttccgcgtcgtattccggcacaaattatgggtcgtatcagtggaggatgtgctctactggatctttgtgggcttcttgtgtttccggtttctctgctggtataattggggagaactccgtggatttttctttttaggtctgatcatcggcatggcagtctattatatgctcatcagcccgaaggtattagaaggtcttgtgtttttgttacataatattagaaaggtctttgggaaaatatttcgtattatccgccatccgtttgccaaagccggaataaatatgagatggagattgaaacaggagagaaaaaacgttaaaatagccttaatgaggaaggggcacaaaagaggtgatacacatggggagaaagataagcagttataaaaaaggactcaggcagagaacaagggtgatcttacttgtcgtcattatgtttgtcattgtgatgtccattgcttaccgaaggctgtcggaaaagtcggcggcccttcagaaagaggaggcccagctggaacagcagatagaaaaggcgaaagataaaaagcaggaactgaaggataagaaggagtatattaagaccaaagaatttatagaaaaaactgcacgtgtaaaattcggattgttttatccggatgagtatgtagttagaccatcaaattgatggattcaaaaagaagtctgacatggatgtcaggctttcttttttgtcataaattcgttgttcctctttccgcttcaagcggaaatttacgaactatcatcaaaaataccatttacctataatgtataacaaagaggaggaaactatggagagatacaataagaggctgatcaagatccttcgcttctttttggaaaatgaaaaaaggattaccggggcaagcattgcattgtctgtgggcgtttctacaaggacggtcaggaatgacatcaaagagttaaatcagatgcttgcggacaggggagcagagatcacgtcagagatcgggcagggatataagcttgctgtgaacgacagccggaaatttgacgtcctgaaaaaagagatccggaaagaagagagttcaaagccgtttcaaaatatcattccgtcagattcggaagaacgggtttattatattatttccaggcttttgctgaactctctgaacagcggggagaggatcgacttctttgatctggaggaagaattgtttgtgagtacttccactctgaaaaaagatttgagaactatcgacgggatacttaaaaaacatgaccttcggatcagtgatacaaaaaaggaaggaatgagagtcgtagggcaggagacgaagatccggttttgtatttcggaatacattttcaacaaccaaaaggatacaggagatatagggaaccagttttacaaggacattttttcatccgatgaggtggaaaatctgaggatcatcctcatggaagcgatcacagattttaacctgcggcttacggatatcgctttccgtaacctgctcgtacatagcctgatcatgcttaagcgtttcgagaaaaaacggcatgtgaaatacgatgaagaagagatcgagctgttttcgggaacaaaggagttccgctgtgcccagcagattataaatgagatttccaggaaattgggcatctccctgggagatgaagtgtattatctgacccagcatctgatctccagccagcgttttctgatcgagaatctggatggggattacgagtataaggatgaaattgaggacattttaaataccatccgctcggggacagggatcgatctgtccgacgacaatcagctgatcaacgggctggccatgcatttgagcgcggctttgcagaggctccggtttgacatgaatataagaaatgagtttctggacagtatcaaaaacctgtatccgcttgcctttgaactggcagtcgtagccggggaggtgattgaaaaaaaacataagctcaaggcaaaagagtcggaaatcggatttctggccatgcatttcggagcggcactggagagaaaagggctgaatcggaaacaggagccaaagaaagtagttctggtctgtatcgcaggcattgccacggcgctgctcctaaaagagaaattacagcataagtttgggcagtacatagagatcgtaaaatcctgtccggtacaggaagtgaacgaagaactgattgacagcgccgatctggtgctgaccacggtagagcttcccgattttcagtctgaaaaaataaaaaagatcaaactgtttctggatgatgatgacctgaaccatctggctacggtgatcacagacagtggaaaccagatgaaagtcattgattacagcagcatcttccgggaagacctcttcttcaccaatatggagtttaaggacaaacaggaaattcttgaatttatggccaacgtcatggtcgaaaagggctatatcaaccaggagatcaagcaatccatctttaaaagggaagagatgtcaactacagaactgggaagtctggtggccataccacatgccctttttaacgatatggaggaggcggctgtttccgtcatggtcctgaaaaagccagtcatctgggaaaatgaaaaagtccaggtagtcctgatgttaaacattccccagagcaaatacgatgtctgggaagttgtatttaaaaacctatatcagtttttgatcggaaattccggcgtggcgaaactggtgaagcacccttgttatgggcagtttatcaaagacttattagaacaggaagagaagcttaaagaaacagcagggaggatatgaagtggaaaagctaatcttaaacgaaaacaatgtgcagctgcagatagaagcaaaaaactgggaagaggcagtgaggatcggagcggagatgctggtcagccagggatgtgctgaaaagtcctatgtggaaggaatcataagtgccatcaaagaactggggccatacatcatcgtggccgacggcctggctatgccgcatacaaggccggaatgcggggctaccggcatcggctgcagcctgatcaccttaaaagaaccggtcttctttgacggggataaggaaccggtaagggtcctgatctgtttttcggcggtggacagcgaaagccatctggacattctgaaaatgatcgttggcttcgtggaaaagggatggattccggagatcgccgcaatgaaggataagcaggaattgtttgattttctcaataagaatagtaatgcctgataaggctgctataaaaagaaacacgacaaccattttaaaaggaggatagaacatgttaaagattttagcagtgtgcggggcagggctcggaagcagttttgcatgccagatgagtgcggaagcggtattgaaagacctgggagtagacgcaaaaatggatcacacggacatttccagtgtatccggggcacaggcagacatcataatcgccgcaaagaattttgaaaagcagtttgagcgttatacgatcagctgcccgacagtatttttagagcgcctggtagacaaaaatgaaatccgggagaagcttgtaccggtgttaaaagaactgggagaactttgaaaacaagaggaaaaagaaagtgaggaaaaactatgcaagtattgaattttatcatcaataatattttaacgcaggcctccatcatcatcgcattgattgcgctgctcggtctggtcctgcagaaaaaaccggtgggagccgtcatctcaggaacaatgaaaaccatgctcggatttcttgtactgtccgcaggttctgctgtcatcgtttcatcgctgacttattttggagacatatttaaggctgcattcggattgaagggtctggttgcctccatcgagggaatcaacggccaggccatgaatgagctggggctgggaagcgagatcgccatcacccttgcgggaatctttatcgtcaatattatcattgcaagatttacaaaattcaaatacatattcctgacaggccaggcattgctctgggaggcgacactctgtgtggtattcgcttattactgtggattaacaggtgtacctctgatcatcatcggaagtatcgtgggaggattctttgcgaccttcatgcctgcctttgcacagcctattgtaaagaagatcacgggcagtgaagatatcgcactcggacacttatgtacaatcggttatatgttcacagcgctgattgcaaaactgaccggcggaaaatcaaaatccacagaggacatcaatcttccaaagagcctggaatttttacaggatacttacctttctgtcatggttgtcatggtaccgctttatgtgattacagctgcatttgcagggccggccgcatgtgcagaatatgcgggaaatacgaactttatcgttcatgcatttttacagggtatgcagtttgtcgtaggtgtctatgtgctgatgacaggagtccgcatgctcttggccgagatcgttcctgcattccagggaatttccatgaagctggttccaaactcagtgcctgcactggactgcccggtattgttcccatatgcgccgaatgcggtcatcttcggatttgtctttacaacgatcggttctattatcggaatgttcctgactccggtattcggacttcctatggtcctgccgggagtactgtccaacttcttcgcaggcggaacagcaggtatatttgcaaaccaggtaggcggaagacggggagccatgatcggatgtattgctcacggaatctttattaccttcctgccggctatgctctcaccgatgcttgccgacattggatttatcaatacgacttgtacggacgtggatacggtagtgaccggtttcctgttcatgctgtttaagtcaatagctgcaatattttagtccgtaaataaatagtttatgatgcggcaggaggaaataaaaatgtttttgtttaaaaagaaaaaagataaagcggcgaaagaagaggctgtacctgaaatcagccgggaagagcttttaaaaaaggccgaggccatacaaaaagagcttccggatctttccggggaggagcggaacaaggcgctgaacgagcttgggagcctgtactttgaggctgaagagacagacaaggcaatcagagcatatgagaccagcctttcagagagcaaagcccttggtaaggcatataccgatctgctgaagctctacaacataaaaagaagagaagcttcggaggcaaaagatgatgcaaagatgaaagaatacatggataaaattgacgggctgatgaaactgtctaaggatgtcattcgtggaaaagcgtaaaggagataaccgatatgtatagaaatttaattgacttgtttaaagaaaatgaaggaaagggggctgtgggtgcttttaatgtgcactgtttcgagatgcttccggctatggtcagagcggcagaggaacttggcgtgcctgtgatcttacagacttctctcggcactgccagatacatcggatttgaaccgctgatcgccgcagtgaaggcaatcgctgaaaaatctgctgtaagcgttgccttacatatggatcactgcaaagatattgatgcactgaaagaagctattgacaagggatattcctctgtcatgtatgacgggtcctctctgtctttagaagaaaacatcaaaaatacaaaagaagtggttgcctatgcccatgaaagaaatgtatccgtggaaggtgaagtcggctccatcggcggtgcggaggaaggtgtggtcgttgccaaggatgacgccatgtatacgaaaccggaagatgccctttattttgccgagaacaccggggtggacgcactggctgtttccatcgggacaactcacgggcagtacaaatccaaggcaaagatcaactatgaactgctggccgaactgaaagcgaaacttggggataccggtctggttcttcacggaggcaccggagtgtccgacgaagatatgaggcgctgtgtcagagaaggaatgaaaaagatcaatgtaggcacagaacttaacaaatcctatatcgaagtagtgagagaaacttttaccggagaggatgtgacccctctgacttcattgagaaatcttctcgggcctgcaaatgacaaggtcgcagatgttgtaaaagagaaagcatctttattcagaatctaagggacagaagataaaaccgggaaaacgcatcttactttcccggttttatctgttacaatagtaagtaagaaaccagttaaacagccgctttagtttcagagagaaggagccttgttatgaagagaaatgaaatcttaaaaactgttgaccacacactgcttgcacagacagccgtatgggacgagatcagagtgatctgtgatgatgccattgcctacgggacggcttccgtctgtatcccgccgtcttttattaaaaaagccaaagaatatgtgggggacaagatgaaactctgtacggtcatcggctttcccaacggttattccaccagtgaagtaaaggaatttgagacaaagaatgcccttttaaacggtgctgatgagatcgatatggtcgtgaatctgggagatgtaaaggaaggcaatgatgataaggttattgaagaaattcgtcttttgaagaaagcctgcggtgacaagatcctgaaagtgatcgtggagacctgtctgctgacggaagaagaaaagatccgtatgtgccgggcagtaacggaagcaggagctgacttcatcaagacatccacgggattttccacgggaggcgctgcgtttgaggatgtggagctgtttaaaaagcatgtgggagagggagtaaagatcaaggccgcaggcggaattgcttcttttgacgatgcagaacgctttctttcactgggcgcagaccgccttggaaccagcaggctgatcaagatcatgaaggaggaatagcctatggcagtagtctgtgtagggcagtctgcctatgatattgtaattccatacgatggagagctgacagaaaatcagaagtaccgtgtcagagaccggctggagtgcgggggaggccctgccatgaatgcggcttatctctgtgccctgtggggagaggaaaccagcctcatcagccgtatcggtgacgatgactatggaaaaaagcttaaaaaaatcctcagagaagcgggggtcgatacgtcccatctcgtagaggaagacgggatagagacaccttacagcatcatcctttccaatacaggaaacggagccaggacaatctttaatttcccaggagaaatacggtaccggcagtatacctatcccaagcttaatgtgagtgtgatcttaagcgacggacaccttcccaaactcagcatcggggccattgagaaatatccgtcggcactgtccgtactggatgcgggaacctgccgtgaaagtaccatggaggtggcgccatatgtggactatattgtctgttcagaagactttgccagacagtatacagggaaggccgtggatctgaataaccccggactgtgcagagagattttcggccggattcagagcatcaaccagaagcaagcggtgatcactctgggggaaaagggattgctgtacgaagaggacggagaactgaaacaccttcccgcctatcctgccagggccgttgatacgagcggagccggggatatctttcacggggcatttgcctgtggactggcaagaaagatgcctcttaaagatattttaaagctgagctccatggcctctgctatttcagtggaaagtctgggagggcagagttccataccgtctctggatttgacggaacgaaagctaaaggagcaggaaagatgaaaaggactttgattttactggcagggtatccaggcaccggaaagacttatatgtgcaataagattttggagcaggagaaggattttcaggtgatctctcaggatgacatgaaggaacagctttgggatgagtttggctttgacaacatggaagaaaagacggctctggagaataaaagctgggcactttattatgagcggacagaagaggccatgaaacaggggaaacggctgatctcggattatccgttcagcgaaaaacagagaggaaagctcgaaagactctgtgaagaatacggatatcagcctgttacgatccgcctggtgggtgatctggatgtccttttcgggcggtcaaagcagagagatctggatacaagccgtcacttgggtcatgtggtgagccgttatcacaaaggggatgtgcttctggaccggacgaaaggcgactgctttgtggattatgatatcttcatggaccggtgcaggaaccggggttacggagaattctgtctggggaaactcatcgaagtagacgtaaccgattacagcaagatagactacgataaaatattaggacagttgaaaaagtggctttagagacagccataaacctcattctataattaggatggggttttttattttatggggaagttctgcgaccttccccatgaaaaaaagctccgcggattgtgcacaactttgttttagtaaatttttgtgaaaaactgcgattagtctattaggtttcttgtaattccgtttctgctgtgctataattatgctaaatcattaaatgaataacaaaaggagattttacgtatgagagaaagggaattaacaaacagggaaatactgatcatgaagtgtgcatggagctcagaaaaagaattgtcggtgcaggagatgcagggaaggctgaaagaacagttcggctgggatgcaaagcgttctacgctccgtacatttcttgtggatatggaaggaaaaggatttatagcgatcgaaaggagggggaggcattcttatataaaggtgctggccgaggaagatgagtataaaaagacccagacagcaaagatgctggatttctggtttgacgggtccagtcaaaagctgataagcgcattgacaaatgaagtgaccgaagattcagtggatcatcttatgggggtattagatgagctgggagacgattgaggtcctgattcgggtattcacaggaattttcctgtgttcggcgacaggaagcgttttatttctttactggaaacctgtcagcaaatatttggagaaaaaaggggatgcaaaactcaactatgcgattttaaaggttattatttgtgcattttttattccggtgctttctgtcatatttgaggatctgtcacataagtcctggctgttttcttctactgctgtgatcagaaacattacggagataacaggcgtaatatggcttgctggagccgcagcttcggggtgcttttattttttgaaatacaggcgtctgaggaagtcacttgagaattcctgtatttgcagcagacagactcagaaaattgcggatgagtgcagaaaaaaactgtgtgtacggcgaaaaatcactgtttaccaaagctaccaggttcccgtgccgtttatctgcggggtaatcagccctgagattatactgccggaggaacgttacacgaagcaggaacttgagatcattcttctgcatgagatggaacattataaacagagggatattttttggaaactgatgtgtaatgtcctggcctgtgttcactggtttaatccgctgaaaaagcagatctgcagtcaggtggaggattggagcgaggtgtcctgtgatgtccatgtgctgaaggtgttcggaagcctgaaacagtatttcagcacgatcatttcgatcgccgcaagaaaaagcggataccggcagtatctggcctctgcactttatgaaaacagcagagggctggaactgcggatgcggagaaccgcctctatcaggaagatgaagggattcccgtggaaaagcgcacaaatatttttcatctgtttttgcactctgggagcggcaacgatctctgcaatatcttatggatattatagaggatacatatatttagaagataagaccagcagcaaaacaatattaaaagaaatggatgcacccaaattaatgaaggaaaagcagcggaaggggacctcattgtcgaaacagaggatgatggaagacgaagtacctggcaaagaaaaagatatatggatagactggtggccgaaagcaaacgaatttttgatgagtaagaaatttcaggcagaaaaaggagacagaatccagatgatgttgttatgttcggagaatgataacccaaatgttaacaataatgaaatactcgcaggagtcataacaccggatggaacgcagaagtttgtctgtgataaagacaagctacagcacagctttttgataaaggaaagcggagaataccagttttttgtagaaaatcagacaacaaagaagattcagctggcaggagattatgaacttattacaaaaaaacgataaaggaagagcaggaatgagaaaaatattattaaaagctatggcaatcgcagcggcctgtgcattgatcactgccccaatgtctgtgttcgcagaagaagtggacggagagacagaatatttttcaatggaagacgatccggatgtgactgttgagactgtggatgaagtactaatgactacatattctacagcgtatgcactgaattggtctgtgggaaataaaatttcaaaacagacaaaagaattcagcaaaacatcagggagtacagtgtccatctatgcgaagattggaccaactgtgaaaaatgtcacgattggaattaaaaaaaccggcggcggaaaaaaatacatcaaagcaaccagtactgtaaatagaacttttacaattacaaagccaggaaaatacagagtatttgttgagaacaaatcagggaagaccattactgtcaaaggaaattaccggcggtagtgatgagatagatggaaaggcggtgatgccgaagaaaaaacagacaggacttgcattagcaacgacacataagaaggcgtttataataaagatccatgcaatacaaatggcggccaaaccagatatctgcaaatgcagatagcgtatcacatggacgtctttattataacagacagtacaactggatgaaaggagaagagttataatgaagaaattggtaaagccaacaatctgtgcggctctgtcatttattttgatgtttacatctgttcagtggagcggcattcttgccggaccaaggcgggtaaatgccgaggcatcaaaagatgtaaaagaagtcattgacagcgagagcacaaaaaattcaactacattccgcctgtccaacggaaagaaggaatctgtgttttacggacaggatgtaaggtacgaagatgaaaatggaaatctgaaagactatgatccgacccttgtggagattaaagacaagaccagcgggcacggacataatctgaaagactatcaatacgaaaacaaagacggggataaaaagcagtatctgcccaagaagctgacggaatccactccggttttgatggagcatgataagtatgaaatctcttttgcaccgatcactggagaagaagaaagcggcattaagacacaggaccagcagaaagaaaaaacagaggagaatgcattttcttgtattaataagttaaaaaggacaaaactccagagagaggaagtcctgacggcagaagacaaaaaagaagagctgccggtcagtgtggcatacgagtcagaagataaaaactgtacgtttttatatcagtcactggacacgggagtgaaagaaagtgtcacattaaaagagatcccggacagcaatcagctgaagttccggttttatgccaaaaacctgacagcaaagaaaaacatcggggacggcggcatcacgttctatgacaaagaaagtgaagacatcattgcctcactggaagctccgtcaatgaatgatgacacgaaagaagcatacaatgaaaaattatcctatgatattaaaccgatcaaggacgaaaaagatacttatgaactgacactgacactgacactggatgaggaatatctgaaagacaaaaaccgcaaatatccgattacgattgatcccacagtcacatggaaaggatcaacagacttctgggacgtgtacgtgatcaatggaagttacaaaaacaccaacttttatgattccggcataacggcaatgatggctggaaaggccagcaagggaatatatcgtacatacctgagatttaaggatttcacggcaaagattaaaaataagtacgtggacactgccacattgaccatgtatgaaaccggtgacagcaccagcggccagacgattgaggcaaggagagtcacttctaactggtcaagacccggacttacatggagtaaccgtcccggatattccacaaattatggaagtgtgacgacaacgggaaccacccataaagcaaggagcatcaacctgaccaaatatgccagggagtgtgcaaacggatctatcacctcctacggcgtcatgctgaaaaatgcggatgaaacaaagaaatacgggcagttttacagttccaggtattcaaatgcaagttatagacccaaaatgagtgttacatattatgacgggccgacaactccgacttctgcttctgtgactccgcagtatatgaagaagggacagacactgacagcgaaatgggcaggcatcagttccaaatccttaaacagggtagaatacagagttgcaacctttgatcctgctaaaaatgcggaagtgaacgcaaattaccgcgcttattccggaagcacaaagcttgggacaacaggaagcggaagcgcttctgtaccggacagtaagaactggccggagggatgctataagttcgtcatccgaggtgtggacaacggagggatcaacggtaccggaaaaggatatatattttatgtagacggggcaaaaccagtgatccatgacgtgatcgtacaaggggaaggagcaaaaggaacaacggaagataatccatcttctgacattgctccggttttgagctggcatgtttcagatacatatttaagtaaggtcgaatataaggtagagaatggaagctatattaatttaggaaatagttcagccggaagcattgctattaacagtgcatcttttaatgaaaataggtcttacactgttactatacgagttactgataaagtgggaaatcaaacagagaaaacagtacagtactactatgaagataaagccaaagtatctgattatcagccaaccgaaccagaggtaaagtcatcttatgggaaagcactgatttcatggaaacaaagttcggcgaatcttccgggaagtatttattatgaagtgcattggggagaaagtgcagactttactccagatgacagcaatctggtacgaagtgctgttaaagatacctatgtcgctgatatgaatacaggtgacggaaaagaatactattataaagtatgtgcagtgaaacttgcaaaatcaggaaaggtactatcaagaagcaattatgttacaacgggaaaagtaagacagcaagaagcaagagagtttgagcagtatctgggagaaaaagactatcgggacacactagaactatcgacaccaaatggaactggtactattgataaagccagcggaaatctgacttattcaggagatgactttgatattaatgtgggtggaatggggttatccttgaccagaacctataatagccaaagtaagaaagcaggtatgcttggaaatggatggtatgatacctttcataagcagttatatcaagtgggagataaccttatctttcaagatagtgatggaacttatattacctttgagaaaaatggaaactcttacacatccaaagaaacaaaagattatacactgtcactgactgaaaataattcgaaggcgtccactttaaaaaatgccgcaaaaagcaccgttttggtcaatacgagagcaaataacatattaggaagaagtacatcaagaacagcaacatataatccaagccataatacaaagacagaaacaggggaaatacagcccgtaatttcggaaaagagtgtaatagtcgtttgtacattgacagataaaaataacacaacatatcagtttgatgccaatggtcatatgacaggaatggaagatgccaatggaaactatgttctgtatggatacaatgaaaaaggacaattagaaacagtaaccagcaataagaatcaaacattaactttaaaatataacggaggagacggtgaggatgcagatcggttaaaagagattgtcttgccggatgagacaaaggtttcctatacatatgaaaaaggaaatctgatcaaagccacacacagttccaaagatggaggagactctgttgtctatcactatgcatatgattcagaagaccacttaataaacatccaggatgcaaaagggaatgactatggaatctcttaccaaggacaaaaggcgagtaaagtcacaaaaccgaatggatcttatcaacaactcacttatggagatggaacaacagcggtatccaatcataagaatgggggagtgaagctttccgaagactcaattacttatgatacatccaatggtaaattattatcagccacggatgtcaatgggattacaacgacttataattacgcagatgcatccaacaatttgctgcagacaggaaccacagccaaagtttattatcaaactttaacagatggggtggtaaactttgcatctgatgataagattacaacgagtacgacatataatgccgatgaaaatgtagtcaaagaagtagatgagactggacaggtaacaaccacaacctatggagacagcaaaaataaaaatctgccgaccaatgaagtgaccagcaatgaagatgggaaggtctccaatgttacaacaacctatgatgaaaatggaaatcctttaacagagaaagattcagttgctgatactgagacaaaatatttatatgataataaaaataattgggagatgacagatgaatggcagtatgaagagggagaagagatctcacatgaaaaagtagacagcgaggaattggatcatgaggtaaaagaatctagtactttgacccaggggaagatagaagaaatttctacagcaaaacaggataacatgggtcgtgagatctacagcaaagatgaaaagacaggggaagagacttcgatttcttatgatttcatggggagagttacgaaatctgtaaagtctcttgatggaatcagtcaaacagaggtgaagtcttatgatgccaatggaatgacggtatctgaaacttctaatacagggattactacttcttatgagtatgattcactaaatcgtgtgacaacagctacggaaagtgccgatggaaaaacaaagactacaaaaacagcgtatggatatgaagatgcgaatatccataccttagatggtacaaaagtatatcagaatctagctgtacagaccgttacgaccaatggaacagttacatcaaaaagttatacagattcagagggaaatgtagtgcgtactctgaatgacggaatttatacggattatgtatttacaggagatggaaaagaaatagcatccattgttctggggacaaacaaaaccgggaaagaaaaggttacagttcaattgtttgataaagaagggaatcagacacacatcattcgaaatccaaatgtaacggcaggaaacattacattacaaaaggatacgatcgttacaaaagcagcctacgatgctaatggtaatgaaacagcagaaacggatggaaaaggaaatgagactacttatacctatgatgatcaaaacaggatcacaggagtgtcccaggatggaggaaatgtcagcagtacgatatcctatgccatgttagatggaaaaaaaacaacaagtatcacggatgccaaaggtcatgtgaatatggaagtgacaaatgaggcgggacttacggaaagtagtatagaccaaggagatgcagaagagcgtatttctacaaaatattcttatgatgacagtggaaataagataaaagaaacttttaacaatggagcatataaagcctacagttatgacaaaaagaaccgcataaccaaaacggaatcttttgaagcaccggaagtaggagaaagtagtggaacaaggacattaaaaacagcttatcggtatgacgcacaggacaggcttttagaagcaattgattatagtgttgtaggaaatacagaaacggcttaccgctatacagaatatacatatgacagccggggaaacgtaacaagctttgcagaactcagtcaagagagccaaccaacggctgaagagatatcagcgaaaaagatccgttatgtttatgatagtgaaggaaaactcacaaaagttgcttatccaaccataaaagacggggtacaaggattaacttatgaatataatgagaatggatggcttataaaagttgaggcaaatgtaaaaactggagaaagcagtaccgaaaagacgatccgaagctattcctatgattcctttggaaaagtaaaagaaatcaaagattacaggaatattctttctgctggagacaaggcagtaagaaaaatctatacttatgatagttttgaccgcgtgaaagaaatgatatacacagatcttgagcatcccgatacggtgatggaatcttatacctatgagtatgataagaattcctatatcacaaaaaaaacagaggtcaacaactatccaccagaaggtgaaaaaaagattgatgaatcaaaggattatacctatgatgccttgggaagactcacaaaaacgataacaaccaatcataaaaaagatgatgaaaagaaaacgactacctatgagtatgataaggttggaaaccgtactttggagaatgtaaacgagaaggctacaagctataattataatgggttagaccaggcattgacggcgacaaaatatgaaggtgtcagcgtttctgaacagatccagtatgagtatgatgcgaatggaaatgaaataagccagcatagtacgaaaacaggagaaactacaaggagaagttatgacgcagagaatcgactgagtaaagtgtctgtagaaaaagatgggaagactatgaccattcaggaaaatcaatataatggggaaggacagaggatacggaagacagaaggagataccgtaaggaactattattaccaggatggagtggtttcctatacgacagatgcagccaagacacaaacaagccaaaatttaattggactggaaagaaacatcattggaacagagcgttatgatggtaaccagacttcctattatatgtataataaagatatccagggaagtacgacaagtcttgtaaaagaagatggaagtgctgatgcaacctatcaatacacagatttcggagagacaacgatcagtggagctaatcaggccagaaatgaaatttgttatacaggtgggatttatgataaaactacagctttttattatctgaatgcaaggtactataatcctgaaggtggaagatttgccacggaagatacctatcgtggggagccaaatgatcaagatacatatcacttgtatacgtactgtgctaataatccaattaactatgcagatccaagtggacataagaaagaatggattagtaagaaaaaaggaaatgtatacaagagaagttttaaagaaatgcgtatatgtacggatggtagaattgcaaacaaatatgaaaaaaagaaaaagagaccttatgaagataaaaatcatcagggaaaaacagcatgttttggtaatgtagttgcatctgatgcggttccgtatattgtaataccttccagtatgaaaaagtataaattttcttcaggagtaattgtgaatagaaaaaatggggattatatgtacgctgtagttggtgaaacaggtggtaccaaaccagttggtgaggtatccatatatgcggcatggaaaatgaattacataacgccaccgaaaaaccatcaagtatacgaaaatcatagaatcggaaataaaagtcaaaatggaagatggaagattattcttttccaaaaatctgctccaaactctaaaaaagcaaaaagtggatggaaatataaaaaaacgagtacacttaatccccagataaaaagtgtaggacagaaatgttataaaggaacaggaaaatgcttaaattaatctatatttgttggaagaggtgtatgcatggaaaagttgaaagtttcaataatatttataatcacactgacattcgtttgtggtttgtttgcagcatgtcaaaacaagtcaaaacaagttcgattttccgatcttgttgattggaacaaggaaaagatagctgaaagcgggtaccctgaatgggcacccgcccttgttcagaataaaacctatgttttttatcaaaattcagattgggagattatacgagttgataaaaataaccataagaaaacaatcataaaaaaacttacaaaacttcgtgattctccttatgatgttgggatgactcttttaaacaataggttatattatatatatgactcttgtctgtatcaatgtgattttaacggagataatgaaactcaaattatttcaaaacaaaaattacaacagtttacaaaaaatacaaatattcaggatacagttaatggagtaaagttttataaaaacgagatgtatttaattatagggtgtgatgtactagtaaagtttaattttaatacaaaggaattgcaaacagtagccaaggaagttgggtccgggactttttataaagatgatttttattacgttgattacacagcattgtataaagtgaatttggagacattaaaaaggacgcttgtgagaggtcagaagtattcaaaaaaattattgaaaataaaggatacagtgtattaccaaacgatcatgaatattaaaggaaagctatattatactcgttcccaaggtaaatgggcatcagagggtggtgcaccatcgaaagtatatttgtatcaagatagtggaaatgatataaaaaaatacaatgctagtacagatttacataatcttgtatatgatggaggaaaaattgcttactatgatacacatcccaaggaaatcaaacttattttagtaatttatgatttggatactggaaaagaaagaaaaatagatctgccaaaggacttctctcaggtagagcagcttgtcgatgatattttattatatcggtcagataagggtcaacttacttattctgtatttaaaatttcttaaaaagcaggtcaagatccaaaaagaactgaacggagttgtaaagtcagaggaaaagaaatgcgatgacaacggtactttcatatcagagacttaagatacaggagttaccacttcttacagctacgacgtaaataaccgggtaaaagaggctgtcgaagtgtcaaaggacggcatcacgaaaactacaaagacaggctatgggtatgccgaccgggagattcacacactctctggaatgaaaagctatcagaatctttctgtcgtcaccacaaccgtgaacggaaaggttcagggagaaacatataccgatggttccggcaataccgtccgggagaaaagcaacggcatttatacggaccatgtatttacagaagacggcaaggagacagcgtccattcttctcggcacaaaagccggagcggatgtcaaaggaaagattactttaaacctgtatgaccgaaatggaaaacagacacatacagtccagaatcctgtgattgccggtgaggatgtttctattaatccggagaagtccattgtcaatcagaccgcttatgatgacaagggaaatgagacggccaagacagacggaaacggcaatacggtggcgtacacttacgatgaccaggaccgggtgacccaaatatcccagggagataacagtacttccatatcctatacgatgggaactgatggggtgagtactacaagcatcacggacgccatgggtcatgaaaacgttgaggtgaccaacgcagccggactgacagaaaccacgacgagcaaaggaaatctgggagagagcatttccaccaaatttacttatgatacaaatggaaataagaccaaagaaacctatgaaaacggggcttacaagacgtatcattatgataaaaagaaccgtctgacagagactaacacctatgaagcacctgaagcaggaagtgaaacaggtacgaggactctcaaaacttcttatagctacgacggcaacgaccagctcatagaaatggtggattatcaggtcagcggaaatacagaaacagcttaccgctatacagagtgtgagtatgacgggcttcagagaaagacaacttatgcggaactgagtcagtcagagaggccaacagctgacgagatcaaaagccatgcgattaaatatacttacgacgcagaaggcaaacttacgaaagttacctatccaacgaaaaaagatggggtaagaagcctttcttatcattacaccagcgacggctggctgtctgtgatcaaagcagatgtatataaaggaagtgatgtaaaagaagcaactgtgcggacttatgcttatgacagctatggaaaagtaacagagatcaaggattaccgaaatctcttatcggatggtgataaggcagtcaaaaagacctatacctatgattcttttgaccgtgtggcaaagatggtctacacagatttggaacatccagaaacagttatggagtcctatgcctactcctatgataaaaattccaacattgtagaaaagacgcaggtaaacaactatcctcaaaaggatgaagaaaaggtcaatgagacaaagcactatacttatgattctctgggaaggcttgtaaagacggttacgacagatcacaggaaagacgacagcaaacagaccgtgacctatacgtatgataaggttggaaatcgtctggctgaagacaaaggggatacgaagaccacctacgattataatggactggatcaggtgaaaacttcgaccacatggaaagatggtaccgtacaagagaataagcagtatgtctatgacaagaacggaaatgagatcggacagaccaatggaacaacaggggagatcctttaccgtacctatgatgcggagaaccgcctgaccgaagtctctgtgaacaaagatggaaagaatgcggttgttcagcagaaccgttacaatggagacgggcagagaatccagagagtggaaggagataagacgaccaactactattatcaggatagtgtcgtctcttatacgaccgatggaaaaggagagcagacgtctcaggatcttttgggaactgacgggaatgtgataggaacccagagatacacaggaaatgatactgcgtattatgtgtataacaaagatgtacagggaagtactacaaatcttctgaaagacgatggaaaagcagatgtgtcttaccgctatgaagactttggagagacgcagagcattggagagaatacggctaagaatgaaacctgttatacagggggacgatatgatgagacaacggggctttattatctgaatgcacggtattataatccggaggacggaaggtttttgtctgaggatacttaccgtggggagacaaacgagccagatacacagcatttgtatgcttattgtgcagataatccgattaactatgcagatccaagtggacattatcccatggaactttcagttaaaatgtattggtttgcattgagtaaacattcaaagagaattaatttatcaaatgtttcgtatcttaattttaaaaaggtgtttaagagcaggctgaaaaattctgaaaaattatatagaatttttaaaggattaagaaagaaagctaataaaaagaaaaaagctacctggaaaccaaaaggtacatttggattttctgaagatagagatttagcttattcggtaggtcacattcgaaatataaggatgactgtatataagaaaacgaaaaaaggatataagattaaattagcattaaaagacacttatgattttgcaaaatttagttttaaaaagcaagggataataaaaacattagtcaacaatattttcggatattatcctcaaagaggtaaagtggttcgtccatacaaatggaaatttacaacaaaattttatcgtaaataacagttattgtaaaagagccttacatcaaaaatgatctattttgatgtaaggccatataatatagaacaagcataagattgcagaaaggatatatatgaaaaaagtagtacaagtaatggctgtaattgtcttgatttttggtgcaatgtgtttttatgtgttagttacagatgatacaggacgagatcccagttatgacttaaatgatggatatcaactaatagcctctagttcaaaatgctggcaactatgctattttgagaataacaaatcagcgatggatggtcaaggagagagcatagttgaagggaatattcaaaaatattttagtaataaagattttatcattgtttatgaaaaagaaaaacagacatattattgtattgataaacgaacgagaaaatgtatatttaaatgtaaaactgaaaataaaatgaagaattttattaaatcaaaatatcaaaaggcaagtgtgaaaatggaagaaacataaagtgaagatatctccattgattcaataatattcatcgctaattaaatagccaagaaacacgcaaacagcttaccgctatacagagtgtgagtatgacgggcttcagagaaagacaacttatgcggaactgagtcagtcagagaggccaacagctgacgagatcaagagccatgcgattaaatatacttacgacgcagaaggcaaacttacgaaagttacctatccaacgaaaaaagatggggtaagaagcctttcttatcattacaccagcgacggctggctgtctgtgatcaaagcagatgtatataaaggaagtgatgtaaaagaagcaactgtgcggacttatgcttatgacagctatggaaaagtaacagagatcaaggattaccgaaatctcttatcggatggtgataaggcagtcaaaaagacctatacctatgattcttttgaccgtgtggcaaagatggtctacacagatttggaacatccagaaacagttatggagtcctatgcctactcctatgataaaaattccaacattgtagaaaagacgcaggtaaacaactatcctcaaaaggatgaagaaaaggtcaatgagacaaagcactatacttatgattctctgggaaggcttgtaaaggcggttacgacagatcacaggaaagacgacagcaaacagaccgtgacctatacgtatgataaggttggaaatcgtctggctgaagacaaaggggatacgaagacgacctacgattataatggactggatcaggtgaaaacttcgaccacatggaaagatggtaccgtacaagagaataagcagtatgtctatgacaagaacggaaatgagatcggacagaccaatggaacaacaggggagatcctttaccgtaccgatgatgcggagaaccgcctgaccgaagtctctgtgaacaaagatggaaagaatgcggttgttcagcagaaccgttacaatggagacgggcagagaatccagagagtggaaggagatcagacgaccaactattattatcaggatggcgtggtctcttatacgaccgatggaaaaggagagcagacgtctcaggatcttttgggaactgacggaaatatcataggaacccagaggtatacgggcaatgatactgcatattatgtgtataacaaagatgtacagggaagtactacaaatcttctgaaagacgatggaaaagcagatgtgtcttaccgctatgaagactttggagagacgcagagcattggagagaatacggctaagaatgaaacctgttatacagggggacgatatgatgagacaacggggctttattatctgaatgcaaggtattataatctctcggaatcctgagtgattattatcggcaacagccgagaaacgtactttgaaaagtaaatattatttaaaacagaaaaaagaacatagaaaatagacataactgtcgctatgcctgaaaaatggtgtataatagtaaaggattatgccacatctaaaatcaactttctcagggtggattcatagggcaaatcccaagcatccaagtgctgcagcataaggatgtgatataggcggcagtaccacatcttagttgagcggtgcctgccgctttctaattgaaagtctattttctcacgtttattcgaacgttcagctgaagttctggcattgtattccagtttccattctttactgtcacgaggcgggaaattgatgaatcttggattatctttcattgcaagatggacggttctcccatatttggagtctgagcagggggtactgcaggagcatccgtatttacggctggcaagtggacagcgaaattttaaccttgctttcgatggctcagaaccatcatggttcatttttcgcccagctttgcaaataggaattccatcttttgcaatggtaaaatcatccttatatttcatgctaattccgcgtttttcatttaagtcgataaaaggctgtatgccgttttcacggcaatactgataatacggcatggcatcatgagcagaatccaaaagccatttgctgatatgaaaatcaggaagaaaggctctgaaacgaaagtaagtttccaaaaaaccatgagaatcatgttttgaggcaggattgagtaaagggaataaaggcagatcactttccgagttggatgcaaccagcatatataaatcgtagccatgataaaaacagtctcgagaagaatcatatccgacatcacaatcgggctgggaaaagtagcggtcgcaatcacaggaagtgataccattttcggaacacttacagatacggtgtttccgttcacgtgcagatgtaacaacaggcataccgtcaccggcaatggaaagattggaggtatcaatcaatcctttggagatggaaacggttaaaaattcatggttgtaaatcttgaaaagagaagcatatggttggtcatcaatagaaaaagaagaagattccatggatttaaaaagttgttccactgtgattttttcaatagattctgctttttctcccttctgttttggcttttgcacttttttcttttttaaaggatgtatatggggagaaagattatcagaatcggaatcccaaagcctgttaagaaagtcatagaaagtgccgactccaggagtgtcaccaaagcgaaacccactgaggattgcatagagtggattgattttcaattgagcagcccagtcggtaagtgaatgaactttaaaatcaatggagagaagataagaacgctgcatacaggaaggagtccttggttttggaccaaagacagaatatttgctgcggagcagttcgtcggtataagaaagatcaagattccagaaacgttcgatgatatcccacgttgatttagaaaaaacagtgggatcaggataatatttacgaaggttttcaagtaaaaaagtctgataggcggtatgaccgccggaataaacaggtaacataaaaatcgccctccagtcgataaaaataaaatatatttaatcggcttcgccgcaaattttgagcgatttgtcaagtcttttttgacaaaaaagtgggggattttaataaaatggaatctacaagccttgattttactgggctgaagattccgagagattattaaaatatttaggaggatgaaataagttgagtaaaaaagtatggaatgtaaaaaaaagtttgatagtaaaaattttgttattgataattgttatttatttttttatgacaccactaggtgctttaaggcttagcattgcctgtaatggatacccattaaaagcaatggtgtatccaataggaaagcgtgaaagatctcttgaggaagaggaaaatgagaaagtatatgttctatacaatccaccagttgagaaagatacagaaggaactctaacaaactggagtgtaaaaaaatatttaatattttatttagccacatatagaggtgatgcctaaagattaggggaataaattgactgcttttgacaaaagttattataaagataatatcatttgttacatatagctacgatggcaacaaccagctcatcgaaatggtggattatcaggtcagcggaaacacagaaacggcctaccgctatacagagtgtgagtatgacgggcttcagaggaagacaacttatgcggaactgagtcagtcagagaggccaacagctgacgagatcaaaagccatgcgattaaatatacttacgacgcagaaggcaaacttacgaaagttacctatccaacgaaaaaggatggggtgaggagcctttcttatcattacaccagtgacggctggctgtctttgatcaaagcggatgtgtataaaggaagtgatgtaaaagaagcaactgtgcggacttatgcttatgacagctatggaaaagtaatagagatcaaggattaccgaaatctcttatcggatggtgataaggcagtcaaaaagacctatacctatgattcttttgaccgtgtggcaaagatggtctacacagatttggaacatccagaaacagttatggagtcctatgcctactcctatgataaaaattccaacattgtagaaaagacgcaggtaaacaactatcctcaaaaggatgaagaaaaggtcaatgagacaaagcactatacttatgattctctgggaaggcttgtaaaggcggttacgacagatcacaggaaagacgatagcaaacagaccgtgacctatacgtatgataaggttggaaatcgtctggctgaagacaaaggggatacaaagacgacctacgattataatggactggatcaggtgaaaacttcgaccacatggaaagatggtaccgtacaagagaataagcagtatgtctatgacaagaacggaaatgagatcggacagaccaatggaacaacaggggagatcctttaccgtacctatgatgcggagaaccgcctgacagaagtctctgtgaacaaagatggaaagaatgcggttgttcagcagaaccgttacaatggagacgggcagagaatccagagagtggaaggagatcagacgaccaactactattatcaggatagtgtcgtctcttatacgaccgatggaaaaggagagcagacgtctcaggatcttttgggaactgacgggaatgtgataggaacccagagatacacaggaaatgatactgcgtattatgtgtataacaaagatgtacagggaagtactacaaatcttctgaaagacgatggaaaagcagatgtgtcttaccgctatgaagactttggagagacgcagagcattggagagaatacggctaagaatgaaacctgttatacagggggacgatatgatgagacaacggggctttattatctgaatgcaaggtattataatccggaggatggaagatttttgtctgaggatacttatcgtggggagacaaacgagccggatacacagcatttgtatggttattgtgcagataacccaatcaactatgtggatccaagcgggcatgcaaaagaagtatcttggggaagaaacacagatgaattacggatatgtacggatggcgtaataaaaaataaatatgagagaaagaaatgtcatcataaaaaaggcccatatggagatttagatcatcaatgtgggactagatgttttaatggtacaattgcatccgacgatattccatatattgtagtccctaaaaatatgaaagcttatatttactcggttggtgttatcgtgaatatgaaaaatggtaattatttgtttggagtagttgcagaattagggccaaatagtaaaggattaggagaagtttctatttatgcaggatggagaatgaaacaaaagggtatgccttcaaaaaataaaagagttcctggccgatatcaaattggaaatagtagtgtaggtggtagatggcttgtgaatgtatatagaaaatctgcaccaaattcatcaaaatcaggctatggatggaaatataaaaatgccagtaaatttaggaaacaaataaaacaagttggtaagaagtattataagccaccacggggaagaggagggagatgtttgaattgagaagagtacaaaaaggtattgttatttaaaaaaatttgagaatatttgaaaaatgaataggatggaatggtttgattccatcctaaatttttgttttattaaagacaggaagaagtggtgtagttatgaaaataattagatataaaaacaatttcgtattttttataatgatcagtttgtttcttgtggggtgtcagagggaaaaagaacatttatcagatatgttcgatttaaaaaatgacaaactagcattggcttattattcagcatattcatctacaatcgttcaaaatgatcagtttgttttctatgaaacggaaaaccaggaaatcattcgaattaacaagaaggattataaaagaactacaattattagaccggagaaaaagtcgaaagtacaaagtgaaggtggattggaattatcaaaagacagtttatattacgttcataataattgtgtttttaaaagtgatttaaatggaaaaaacattcaacgacttctttccgcaaaggagaagaaagaaacagaatggattaatggaattaaaatatataacaatgaaatatacttgttggccgatggtgaatgggataacagtatttttcgattctatcccaaaagcaaaaaacttgaaaaagtcgcagaagatataaggaatccatgtttttctggaaacaatctgtattatatagaacatggggaagtgggaataaataaggttgatttaaagactctaaagggtaagattgtacgaggacaagcatggaaaaataaattgcaatatgaggatgatttagtccgatataaggggatcgtggagaatgaagggagagtatattatatttgttgggggaaagatgacaaagtgagactataccaatatagagatcataagaaagacacaatacaacatggcttttctgataattctgatgattttgtttataattcatccattattgttggatttaacacccattgggatacctcagaggaaaggtatatccaaatctataacttggattctaaacaagaaaagaagattaaaatgccgaatgatacttggtctgctgagtttgtgatagatgatatggttgtttgtacttatctctatgataatggggagtttggtcatatactaaaattagatatataatttgttacagcaaaatttagagggaaataatcaaacggatttttataaggcagattctgtttcatttgcaattcttggtggatcatatagtaatgctgaaattttgataagagatggtaaggtggactatacacagaacccggaggacggagaatgtgttacatggagttttatttgtgcgttaggtaataaaaagtcttttagagcaattcaaaagcttggatacaaacctacggatttggaagtatttcatgcttatgaaaactctgatatggagacatttcaatatttacttcataaggattattcaatttatgtacaggaagatggcgataatatcttggatagtgtctgtctggattcaccagataaagcctggactttttgtaaacgaggtttatatgcttcggagtctaatcttaaatctctaatatggattggaaaaggcgatgtagttaagaagataatagaaagcaaaaaaacaaaaggggtagtcagaaaagaggagcttctccaggaatcaataaatattggagatttatcaatggtaaagtactttgtagaaaacggtgctaatgtaaatcgatatttatacgataaaacaaaagattattcctatacatcaatgcatatggcatccggaagagaaagttcaaaaattgtttcttatttaaaaagacatggaggagatattcattaaaaagattctaaaggaagagaatgcaaagaaatagcgaaaaaagcgggatgtatttggaatttagaattcttataaacatgattttagagggttttatgatgaattgaagattattttactatacagataaaggcaactttcagtttttttagtgagaatgaaattattaataaggaggagttcataatcttgtatcaagaaatttgtaatactcaaatagtaaagtttgataaagagcttatagttgatgtatttattcaagccatgtcattaattatttgcctaatttttattagtgcaattttatttgttatatactgtatatttaaaaaaatgaagaaggctggtaaaaaagaaaaatgaagtcatattgagtttatcactatcagaagaacaaaaacatttcaggcgaggagcaaactgtatttaggttagtaaatacaaaaaggtatagggatatgaatgtttatgaactaagtttttggtatcaggaagaagaaaatgatgaggaggatgaagtaacaattgcagtgtattcttcattggaactggctgaagaggcgagagaaaagtttaaaaagcatcccagatttattacacatgaacatgagttttatattgatgagtacaaattaaatgaaccggaatggaaagaaggttttatcactgatgaggatttatattaaaggagatgaaaagagaggaaaacaagggggagaatagagtcaaatgaaggtggggtgataggaatgacaatttatgaattgacattttactattgggatgaaaatcctgaaaatgatgacgagacttttattgcagtatattcttcatatgaacttgctcagaaaggattagagaaatttgcagaacagcctagatttaaaggtaagagagaagcattgtttataagtgaacatgagttaaatgttgaaaatagtttctgggcagagggattttttatagatgatgtttcaaattattatatagatttaggagatgggtttacattagaaaaatttgaagatcatgttataaaaattattttgaacgataaaacaggaaatcaacaagagctatttacaggaactattcatttttatcaactgatggaacaatgtatacttctgaaaaataagataacaggatggatgtattgtatcaataaagagcataaaagggtagaacagaagacaaaaagtatcggtcatcagtcgaagggtttaaagattatccaagaagctttaaaataagaaaaattaaagttaatgaggataattattatttttatagatgacaaattatttaaagtttgcttttaagctagtttatgtaggagtgtaataaatgaaaaagaaaaaggtatttatatttattattgtgttagccagtatcgggtggggtatatatcattttacttttgatactcaggccgttccaaagggaaagttgtttaaaagtgtaaaatctccgaatggacaatatattgctaatgcgtttcatgggcaggataatgctacagtagatttttctgttattgtagaaattgaagatacaataaaaaataaaaagaaaaatatatactttgaatatcactgtgaagaggcagatataaaatggctgtcagataataaaatcagaataaatggaaagaaattaaatattcacaaagatgtatacgactttagacatgagtaaagacaaaatatttgataaaaggatctacaacataagattatccatagcatggtattaaacaccgtgctatgggtttttaaatggaattatatattttatatttaaactacggataaatttatctgcattaaaaatgtatcggcatatgagggttgaaagttttaggtggacagcataatccaaagctaggagatagatatatccctcagctctggattatattactgctgttgttgttaatattactattattgtgagtgctgatctctggcttgatataggaaatatctttagttttctgatgtgttgcagcacaaagacaatataaaagcagtcacgttcaccttctgattcttgaggatagttctggatgctgcgtattacgtatataacaaggatgtccacagcagtacgaccaatcttctgaaagacgatggaaaagcggatgtgtcttatcgttatgaggactttggggagacatagacaaccgcctccaaaaggaggtcgattgtatacagtctgagggtggaatgttagtgaaggtggattggaattatcaaaagacagtttatattacgttcataataattgtgtttttaaaagtgatctgaatggaaaaaacatttgaaaacttctttctgcaaaagataaaaaagagatagagtggatccatggaattaaattatataacaatgaaatatacttgttagccgaaggtgatgaaggtaatactatttttcgattctttcctaagaacaagaaaatggaaaagattgcagaagatataagaaagccatgtttttctggggacaatttatattatatagaacatggggaggtaggaataaataaggttgatttaaagactcgaaagggtaagattgtacgaggacaagcatggaaaaataaactgcagtatgaggataatatagttctatataagggaattggagagaatcaagggaaagtatattatatttgctggggtgaggatggtaaggtgagattataccaatatagagatcataagaaagacaaaatacaacatggtttttccgacaattcttatgagtttgtttataactcctctatgattgttggatataatactcattgggatagctcagaggaaaggcatatacaaatctatcacttggattctgagcaggaacaaaagattaaaatgccaaataatgattggtatgctttgcttgtagtagatgacttgttattttgtggttatccagatgataaagatgatttctatcatatgttaaaaatagataattaacggaaaaacactggacatccataaagatgtctatgatttcagacataaataatattttcctgtgtgacatggtcacagaatgatcacttcatttcagatatgataacaccagatatgatattttaaaaaatgtgaggtggaaaatatgaggaaaaaaacagtgatcatcggcggtgtggcaggcggggcaacgacagcggcccgacttcggagaaaagatgagaacatggaaattgttcttctggaacggggtgaatatatttcctatgccaactgcgggcttccgtatcatgtaggggatgtgatcaaaaacagggagtctctgcttcttcagactccggaggccatgaaaaagaaatttaacgtagatgtcagagtgcggaatgaagctgtgaaaattaacccggaagatcagacagtgaccataaaagatttaaaggagggcagagcgtatgaggagagctacgattatctggtgatcgccacaggctcctctccggtcgtgcctccgattcctggcattgacggaccggatatttatactctttggacggttccggacacagacagaataaagaaagtcatagagacaaaaaagccgaagacagcagcggtaatcggcggcggattcatcggccttgagatggcggagaatcttaacagggctggacttgaggtgagcattgtggagatgcaggaccaggtcatggcccctctggatttcgagatggcccagcttcttcatgaaaacatagaaatgaacggtgtcagcctgatactgggagatggcgtggcatcttttgaatataaagacgggaaaacgtttattgcgctgaacagcgggaaggaattacagacagatatggtcctgctgtccataggagtgcgtccaaacagtgagcttgcgaggaaagcgggtttgaaacttaacgccaggggcggtattttaacggatgagatgctccggacttccgaagagaatatatatgcggtaggcgatgtcatagaggttgaaaactatgtactgaaagaacctgcaatgatccctttagccggaccggccaacaaacagggaaggatctgtgcggataatattgcaggagaacagaagaaatataagggaactcttgggacttcagttgtccaggtatttgacctgacagccgcggcagcaggggtcaatgaaaaaacgctgatccgtaaggggaaggtccgggggaaggactatgaaactgtactgatcaatcaaaaatcccatgcgggatattaccctggtgctgttccggttacattaaagctgttgtttgaccttgatggaaacattcttggcgcacaggcagtggggcaggaaggtgtggataaacggatcgacgtgctcgcaggcgccatacgctccggaaatacaatctatgatctggaagaactggaactcgcctatgctcctccttattcttcagcgaaagatccggtaaatatgctcggctttacggcagagaatgttttggagaagatggtctcctttatgagctgccgggaactggatgacaggatcgaaacagaaggctgggagaaggacttaaccattttggatgtaaccgaagagatggagcggatggtattccatattccgggctctgttcacattccgctggggcagctgaggcagagaatggctgaactgccgaaggaccggcttatcgtaacttactgtgcagttggagtccgttcctacaacgcagccagaatccttaagcagaatggtttttcagatgtaaaggtgctggaaggaggaacgagtttttatcagtctatgcactacaaagacggagagccatctgcctgccgggaagaaaaacagctgaaagcagcagaggcagagccaaaagaagtaaggcttgttgactgctgcggtctgcagtgtccggggccgatcatgaaggttcacgagactttagaatccatggaggatggagagacggtcaaagtggtggccacagacatgggattcccaagggatattgaatcctggtgccagagaacaggaaatacgttagtaaagaaggagcgggacggaaaacaaaatgtagtctttataaaaaaaggaaaagaagggcaggaactgtgtgcggcagccgctgacacaaacggcgggcagggcaaaacgatggtcgtgttcagcggagatatggataaggccctcgcttcctttattatcgccaacggtgccgcagccatgggcaggccggtcacaatgttttttaccttctgggggctgaacattgtgaggaaatcagaaaaacagcgggtaaaaaaatcagttgtggaaaagatgttcggagtcatgatgccgagaggaagcaggaagctcaaactatcaaaaatgaacatgggcggtatgggaacaaagatgatgaagagggtcatgagagagaaaaatgtggaaactcttgaaaatctcatgaaacaggccattgaaaacggtgtgaagctggtggcctgtaccatgtccatggatgtgatgggtatcaggaaagaagagatcatcgacggtgtggaattcgcaggtgtagcctcctatttgggagatgcggagaattctgatgtaaacctttttatctaagcagcaaaatgcagcaaaacggtatctgtccgtttgctgcattttatttcagctgatcagctgttttatgccctttttatcaaggattgtgactccgcctctggacagttttaccaaaccttccgatgaaaagtatttcagcatacggcttacaacctccctggcgcttccggtgtatttggcaatctgttcgtgagtcatatggatgtcgtcagaacccgtttttccgctctcatccaggagaaagatcgcaagcctctgatcgaaactcatgaacaaaatctgctgcatggtccacatcacatcggaaaaacgctcggtggcctgcttataggtaaatgcttccgcatagatattccggtcaacgatttccgaatatgctcctgcgctgatctgtatgatttcactttctgttaccgcctccatttgtacttcaaaagtgatggcagacagtacgcaggaagcagaaaggacacagacatctccctgttccagacggtacagagtgatctcttttccttcttctgagagcatgaaagtccgcacacttccgcttttgatgatcagcacgccggtacactcacagttctggcaccggatgatccctcctttttcgtagcggacaagctgagaccactgggagagagtcttcttttctgtttctttcaggtgctcccaaaaaggaagggacgactttaagatagggatgatttcatctgcatgctccattctatacctccaattaatacttttcatatattttagctgtcccaaagagaaataacaagagctgtttgcatggaaatcggtcccttagattcgtttcagcaaattatgacacaagatccttgtataattagaagctgaaggagggtccaggatgccgattataaagaaaaaagaaccagtagaagagatatttttcaatgagctggaagatatcatatcatataatatgaaacagatggagcactgcctcactacgatcggaaagcggatgtgtgcagagcaggatgaagacttggaaaaaaagaccggaagaacaatcatagagagtacgattttaaaagaatgtatgctgtgccgggaaaaagataagtgccggctgacgctggatgacagggacaagctgggggaacttctggagaagcagggaggcctcagtgtgcagaatatccgctctgtctgcaaatgccagcgagagaaggagtgggtggaagagatcaatacgatctatgaaagggagctttttttgtatgcctgtgaacagcggtttatcgaaatgcgcaggatgatcggggaacagtacatagaggccggaaggatgttcagaagcttctcggcccagaaatatcagctgttcggagtccgcccgatgcaggaagttattgagaaagggctgaaagcccatcatctgagagtaaaaaaggtttatatatatgaagatgacatgaggggaaagcagatttacctgtttttaaaagcccagaagggcagggaggtaacgaccaaagaagtagcccggtggctgtcggtcattctccaggaaaaacttcagccgctgcccaacggtaagcaggccatcggggagaactatgaaatgatgggggtgcaggcggctacaaaatttcatgtgctgacaggggtgatttccagggcagagaaagaagatatgaaaaatggggataatttttctatggggactgtgggaaatcacaggtttgtctctatgatctccgacggcatgggcacaggaaccgctgcaaacagggacagtaaagcggttatcgagacactggaggaacttctggaggtaggcttggatgagaaaagagccgtccagcttctgcagtctatttttgtattctggccggagaaggagcgctattcgacccttgattatctgcagattgacctgcacgcggggatcggaagctttctgaagctgggtgcctgcccatgtttcctgaagcggaagggacaggtggaaatggtgcagcttcccagtctgccggtaggtgttttaaaggaaaagtcactgcctatacaccggaagaagctggaggcggaagatttcattttacaggtcagcgacggcatcatcgactccatgggcgaaaaaggagtggaactgctgatggagtatatgaagcagatccacacgacacgtccgcagggatttgtggatgaactgatggagaagatcgaaaagaccgagggatacgaaaaaaaggatgacatgacgatgattggtctcgggatttgggataagtattgaatccttggattgggaatgataaagtattgatatggataaagtactcaggtttataaaaaaacatcatatgatcagccagggagatttcatcgctgtgggagtctccggaggagcagactctgtgtgcctgctcctgcttttatgtgagcttaagcaggagtatggacttgaattgcacgctgtccacatcaatcatggtatccgcagggaagctttcaaagaccaggaatttgtggaaaacttatgccggagactgaaggtaccgtggataactttttcggaagatgtgcaaggcatggctgaaaaagaatccatgtctctggaagaggcaggacggataatccgctaccgatgctttcaaaaagttctggatatgcacggaggcggaaaaattgcagtggctcatcaccagaatgaccaggcggagacaattctttaccggatgtccagggggaccggaatacagggtctgaaaggaatggaagccgtccggggagatgtgatccggccgcttttgtgccttaagaaaacggaaatccttaagtatttaaaagaaaagggccaaagctggatggaggacgccagtaatgaagataatacgtttgccaggaataagatccgcaatcaggtcattccggtgctcacagaagtcaattcaagggctgtggaacatatattttcactgtccgaagaaatagaagagtggagccgttatttggaacagcagttgtctgaggcgtggaaagcctgtgtaaagcaggatgaaaagggatgtctcatcgatacaggccggtttctgaaggaatcggagccgatcaggagacttttggcaaaacaggccatagaacagaccgcaggcagaaaaaaggatattgagaagatccatatccagagtttctgtgatctggctttcagggaaaccgggaaatccattgatcttccatatggacttactggaaagaaaacatacggaggactcttggtggaggctaagcagacaacagcagaaaaagcggctgtgggacagctggtcctgacggagacaaaccggtttgaaaaaatggatgaaaaagattttaccaaaatcattgattatgataaaatagacaaagacatccaactgaggtacagaaagccgggagacttttttgtattttcaaaagatggaaagagcaagtctttgagccggtattttattgaccagaaaattccgagagaagagcgggaccggataccgcttgcggcagacggaagccggatcatatggatcatcggtcgccgcctgagcgagttttataaggtttctgaaaaaacgaaaagatatttaagattggaatacaattaggaggaaaacattaaatatggaacaagcagagattagagagttgatctcagaagaagctgtggataagagaatcaaggagatgggggaccagatcagcaaagattatgcgggaaaggaagtacatttgatcgcgatcttaaaaggcggcgtcttttttgcgtgtgagctggccaagaggatcacagtcccggtaacgattgattttatgtccgtgtccagctacggggattccagagagtcttccggtatcgtaaagattgccaaggatctggatgaaccgatcgaggataaagaagttctgatcgtggaagatattattgattccgggaaaacactgaaccacttaaagccaatgcttttgagcaggaagcccaggagcctccgtatctgtacgcttttgaataaaccggagcgccgggaggtggatgtggaagtggcatacacaggttttgacgtgccggatgagtttgtcgtgggctacggcctggattttgcacaaaattacaggaatcttccatatatcggagtcgcagaagaatagcagagaggagacagtaagttgaacccaagaagaggaaacagcaattttttgttccttgcagtcattttatgtctggggattatttatttttccagaatgatgaacagcaccgaggacaattataattacgcacaattccgtcaggacgcaaaagcggggcaggttgtggggatcaccatgaagcagaataaagaggtcccaaccggcactatgacggtagaattaaagaatgaagtgtataaaaactgtaatatcaccgacgttgacgcggcggtaaaagagatcgaggataaatacccgaatctctataaaaaaatggtagtgaagccgatcgaccggagcggagactggatcacgaccctgcttccgaaccttttgatggtgggaattcttgtatttttcctgatcatgatgatgaagcagaatggcggcggcggaaaaatgatggatttcggaaagagccgtgccaagatggcaaatccggacggcccgaaagttacatttgacgatgtggcgggtcttaccgaggaaaaagaggaactggaagaagtggtggatttcttaaaagatccgaagaagtttatcggtatcggggcaagaatcccaaagggagtcctcttagtaggacctccgggaacaggtaagacactgatagcaaaagccgtggccggagaggcaaatgtcccgtttttcagcatttcaggttctgatttcgttgagatgtttgtcggcgtcggggctgccagggtcagagacctgtttgcagaggctaagaagaacgcaccttgtatcatttttatcgacgagatcgatgcggtggccagacggagaggttccggcctgggcggcggacatgacgagagagaacagaccttgaaccagatgcttgtggagatggacggtttcggcgtcaatgaaggcattattgtcatcgcagctacgaaccgtgtggatatcctcgacccggcgattctccgtccgggcaggtttgaccggaaggtcggcgtgggaaggccggatgtcaagggaagagaggacattttaaagatccatgccaagaagaaacctctgggcgatgatgtggatctccacgagatcgccaggacgacggcgggattcgtgggcgcagatctggaaaacctgatgaacgaagcggccattcaggcggctaaaaataaccgcggatacattgtaaaagaagatatcgacaaatcctttatcaaagtgggaatcggcacagagaaaaagagccgtgttgtccctgagagcgagcggaggattacggcttaccacgaggcaggccatgcgatcctgtttcacgtgctcccggatatgggaccggtctatacggtttccatcataccgaccggcgttggggcggcgggatatacgatgccgctccctgaaaacgacaatatctttaatacaaaaaataaaatgctgcataatatcatggtaagtctcggaggaaggatcgcagaagagctgatctttgaagatatcacgaccggtgcctcccaggatatcaagcaggttacccagcttgccagatctatggtcactgagtacggcatgtcagaccggctcggtctgatcaattacgacagcggtgaaggggatgaagtcttcctcggaaaagaaatcggccagccccgtccgtacggagagcgggtggcaaccattatcgatgaggaagtgaaagacatcgtggatgactgttataagaaagccagggcgatcattgaagagcatatggaagtactccacagctgtgcaaaactgttattggaaaaagaacgaatcaatcagagtgaatttgaaaccttgttcgaggggacagaagcgtaaaaaaactgccgcactaaaaaggtgtggcagtttttttgcacgaatatggataaattctgctggataggaatttaaagattgttggagatgtctacttttctccgtgcttctttccgtttttccatggcatccacacagatagtgcaggctgcatccccggtgatattgactgtggttcttgccatatcaaggatacggtcgactcctgctacgagggcgattccctctaaaggaagcccgacactctggagcaccatggcaagcatgataacgccggaccccggaactcctgcggtgcctatggaagccagggtcgtagtcagaatgaccatcagctgctgggttaaagtcagatgcactccaaaaatctgagcgatgaaaatagcgctgaccccctggtaaatagcggttccgtccatgttgatcgtagcacccagaggcaggacgaagcttgcgatctcttttctggcaccaagcttttctgtacattcatagttaaacggcagagttcccacactgctggcactggaaaatgcaaagagcatggccgggctttgttccttgaagaatctgagtgggctgatgccgctgaatcctttgaccgcgcttgaataaactacaaccatatgcacgatgctggcaagataggctaccccgatcaatttcagaagaggaagcagtacggacggaccatttgtggccacgaccggagtgatcagtgcgaacacgccaatcggcgaaagattgatgatgaggcccatgatgttgatgcagacttctgagagactctccacaaggtctgccgcaggttttcctttgtcaccggcaatgatgatgccgaatccgaaaaacagtgcgatgacaataacctggagcattgtggcactgactaaaggctcgactgcatttgacggaaagatatttacaagtgtttctataagggaaggggccttggtggcaccttcatatgcctccagagaagaactgttcatcacgtagccgcctcccacgttaagtacatttgcgaacagcagaccgaatgtaaccgcaaacgccgtggtaacgatgtaaaagcagatggtctttcctccgatggaacctacctttttaatgtcctggagagagacgactccctgaatgatggagaacaggactacagggacgacgatcattttgatcaggttcaggaaaatagttccgaaaggctgaatgtaattctcagcgatcttcggatgactctgaagcagaagaccggacaggatacctaagaatagagccgtcaggatcatcacggtcaaggataatttctttttttgtttttttgtattcatactttcttttctcctaaatttgtagtatagccacgaaatattttaaaggaaaaaggcggaaaaaacaatgggattcatcggaattctcaaaaagtacttgcattttcatatttcatacagtataattctaaattgtcaggaacgcggtgggattcccgagtggccaaagggggcagactgtaaatctgttggcaacgccttcgaaggttcgaatccttctcccaccatcagccgttgtggcggaactggcagacgcacaggacttaaaatcctgcgggacttatactcccgtaccggttcgattccggtcaacggcattaagtaaaagtaggagaaaggttgaatttacagcacctcactatataacataaagaattattaattatactttgtgcacgggggatatgcatgaagtatggacatttggaattaaggacagaagaactgttgcaagaaaagggtatgcagagatatggaagtctctcatgccttttttcttgtgcatttttaaaaatagagttatattgtgaataatgaaagttaaataaatttgaagtctgataagacacaaatatgaatttacggaggtgatgtaattggatattatagcgaagctgacatcgaaagacgataagtacgcttgtgcgattgcagataaaatcatatcagaaagtaaggagacagacgagtggtatgaatattttgatgattttgcctccctgctcaatcatccgaaatcgttggtaagaaatagagtgctgtatattcttgcggcaaatgtccaatgggatgatgaaaagcgctttgatttgattatttctgacttcctatctcatattacagacgaaaagccaattacagcaagacaatgtatcaaggcacttaggcaaatagggcagacagaacgccaatatatcccgatgatactatcagctttacgcagtgctgatttatccaagtataaagacagtatgcgtccgctaattgaaagggatattgcggaaacagagaagatacttgcagattagaatttgacggtgggaatgatgaatagataacgatgtaaaagcattttgacaaagcaaattataaatgaaaaagtgatttgatagacgaaatatatatttctgtttatgatataggtagaaaaaggagggtggttatggatatagggacaaaaataaaaaatgcgcgaataagtgcaaatcttacacaagaacaagttgcggaagcactcgatgtaagtagacaaacaatttctaactgggaaaatgaaaaaacataccctgatattgtgagtgtcgttaaaatgagcaatttatataacattagtcttgaccatctattaaaggaggaaaagcctatgtcaaattatttgaattatcttgacgaaagcaccaatacagtaaaaagcaaaaataaactgtctatgcttattttatttgtaacctacctcggaatttgggctgtttcgcttatagtgttctggttttttatcaacagttcggatgcaatgggatatagtattatgtatctatgggtacttcttccggtaacaacatttgtgatttctttactaatcggaaaaaataattatatgggaaagtggaagtggggttcctcgattgcatttggtattatgtatatgctagcagagtatgcaacttttagtgctgcgaatatgattacttttgataaaatcaatgtaccgcaatttgcaatgatattgataggagcaattatttctcaagttggattagtagtaggcgctcttatgagatatacagagttcaagaatacaaaataatacaaaaatgccactttgttcaggaagaccttgtcacgcaggactggtttccatttcttcggtttcctcgtctttttcttttatatgacggttcagttttttcatctccggaacgacaaagagggccacgattacggcagatgacatatctgcgatgggtcccgcaaagaggattccgttgagccccaaaaagagcggaagaatcaggatcaggggaaccaggagcaggagctggcgaagcattgagaggacagacgcctttagaggctgccccgtacccttcaaatatccggggattgggaaaatacttccatccagtgacgcactggttcataatctcgttgatttcccgaatttaccattgtttcggctcgtcaaagtcctggtttaatgcttcccggaaaagctgcttggacatacggcgctgccagtgtagcggtcaagatatgcctgtatcatcccggccttagtgtcctccggcataaaattccgctggtgttctttcagatagcgtaccatttcggggctgaaagacagcttaaaatcgccgcttttgtatattgtcatggcttccgtccatacctgttcgatgtaggctctggaaacgccggttgccggtacggtcaaggggaaggaggtccagggcgttggaagtccctccaaacacgcattgccgcagcctgtcctccgggtgggtttcgtatggtattttatagacctccttctggcggcttaaaaatgacttgatttcctcaatgctcttggcgttggcagtggcaatcatctccgacatttcaataatccagtggccttgtagcttgcggtatacgttttcatcgaccagcttccgcaaatcatcggaaaaccactcgtcctttaccgccggcagacggaaaaaaggcagacttcccagctccctgaccgcctaccagacaaagcatgacctcaaatttacagccggggcagaacgcccgccggatggctcccagaaggaacagtcgcagggcctggtaggtgtacttgtctgtgtcggctcccagaaagtgccgcaaggtcggtgtgggtcatggcctttccgccggttctgcgtttcctgccgacaggctttagaaggtcaatgcgctcggtcaacaggttctttgcaaccgccccggaaaggacggggtcatactggaacacggtcaaacaattctgaatactgttccttacgccgcccttctcggtgccctccagcatggctctgacttcaggggcgctccggggcagcggggcggcttcgatagcgtccatcacggtctgccgcatttctgacggcaaggtctgccattcttcgctaaaggcttctcacttcctttccatagctggcaatcagggcggctcgttcccctatatcagagaacagcagcacatccagcagatattccacatggctcatgcgctgcaaggctgccacaagaagcgggtggaagtcctcgtccggcgttttgggggcatagtcctgtttccagcggcgcaaaagattgtggtagccggacagtacccggaagcagtaacgctccatgcgcttaaattgctgctccgggctttcctgccggggttcccgcctggggcggctccctgtccgcataggagatagagaagtctatccatctccttgttttcagctggcttcattatacaatgtccgttcataaaacggcggcactccggctctggcgcttggaaatatttatctgctgtgcctaacgggtagtgcttttcatctgtgaggtattcaagggatatttctcttttgtatttcctgttccttgtccttgccgcattgattgttgcgttgcgtatgacaactttacaaaaggcatggaatgtgtattcgatatgctctttatattcttctgtacaggtcatagaaattccccctttcctccataaagggtgctacatagttgatgagttatttaatgcaaagtacaataaatctttgtcatttgccttcttggtattctctccaaataaagcaacgttcctcatactatttctttcttgaatatcccaatacacttacagcgtaagagaagatgaacagaacagcagagataaggaagcccgctaaaatgtatgctgatattgtatcagttaaagaaacaagacctggcccatcttcaaagtatttaataagatagaaaataggcacggttacaagaagccccattgtttgtgcggaacgaaaaccaaaccaataagtgaggggcaagcaaattgctgtacatattagtggaataatggtggctactgatacagaaacaaatagcaatgctccatcaaaactttgatatataacacttgatacaaagtagagaagaatactggccgcaatgcttattcctattgttagcagaacagaaatatatttgctccctaccgcaaagaatgaatttaccggcatagtaagctgatattttttccatcgtacttgttcatcgctggcaaaactcattacattttgcataccgacagtcattgcaaacataattgttgctaaaagtccggaaaaatccccggcgtttactaaaagtaaaataatcgctgcggctgctatgataatcagctttttgtcgatacttttgtaaaataaagaaaagtccttataaatcagtcctctcattttgtcgaacctcctttgatatagaacagcataatttcctctagcgaagcactatcaacaaccacatttttgtattttctccgggcggcttccttatcccgcacaagacattccatacttacatttgttttccttgaaatgatataatcctctggctgtatatctgcaaactgttttttctcacatcggataattccatactgataaatcagagtatccttttcttcctcaaatacaatctttccctgatgaattaaaatgacataatccgctatcttttctatatcagatataatatgagatgaaaagaaaatggagtgttcttcgtcctgtatgaagtctaaaaacatttccagaatttcatcccgtactaccgggtcaagacctgttgtggcctcgtctaaaatcagcagctttggtctgtgagccattgcacatatgatggatagtttcattttcataccttttgaaaaagagctaattggtttggaaaagggaatatttaattttttcatgtataaggtaaacaatgaattatcccatgtaggataaacgccggaaaaaatttttgctacgttctgcgctgtgaaaaaatcatggaaattacattcgtcaaatacaacgccaatttcctttttaacagaactattcagcgtatctgtccccaatatttcaatcgttccactatctcttttcaactcatttagaagaagattgattgtggtactttttccagccccattttctccgataaatccaacaatccttcctttaggtacttgcaacgatatattattcagcgtaaagccatcgaaagatttacacaaattttttacagagatattgttttcactcattttatgacctcctgttattcctcatacaacacttttagaatatttgccatctgctcataagaaatgccatgtgagcgtccaatatccacaacctgctgtaataattcttctgcctttcgtaactgttcttcttgaataaactctttattttgggaagcaacaaaactacctttccctgatacagtttcaataaatccatcacgggttaaatcctcataagcccgttggacagttatcacgctgatatgtaaatctttcgctaatgcccgcatagaaggaagcatttctccagcttccaatgttccattcataatcttattttttatctgtgaactgatctgttcataaatcggcttatcgctactattacttatgacaatctccataatttccctctcgtgcgtactgtctgtattttgcgtacttgttcgataagtacagtatatatgattgtgtggaacctgtcaacaaaaaaatagcaaaagcggtaaatacgcctttgctacctggtagctcactgttattccattttatcatcttccaactcaatcacatctaaaatgtcacaattcagggttttgcagatacgaaccagcgtttccatgctgatgttctttccctttcccatgttggcaatcatatttgtggtaagaccggcggcaagccgcaagtcctctttcctcatattgcgctcaaccagtgtgtgccagaggggtttatagcttatgtgcatttatcctcctgcctttctccaggctccggggtttctgctcccattatatcaaaattcttgctaactcacaaacatttcttgacagaactgccggttccgtctggattgtgcttttcctttctcttgattacatctacttagccataaactgggtgatgcctgaggaagtgcccagcgcgatcacatttttgcagacagagccatccagctttaattcttttagatgcagcctcatctggctccgtttgcagaagtagagaaacaggatcagtgcggagatgatctgtgatgtaatcgtcgccacggcagcgccccggattttcataaatgcacacaagaaaaaactgttgtccccgaccaatctcagtgtcagccaggcaacaattaaaaaatctcattccgtggcgatggataacagagattaatctgctgatttttttcatagaatcctcctttttagaataaagttgaatacacaactgttttgggccaaaaaaaatagtactttgaatacgaatcaatcaaaatactaatctgaataattaaagtataacataaattaattgcatgtttaactatattccgaatgcaagcttatatcgcatataattaccataaactaccatgaacgattcgggattcccggtgataaaatgaagacataaaaaggagggagaacatgggatatgggcagacagatgggaggaacaagaaagaatatgatcaccggaaggtgccggacccttcattgataccggaagataagccttctgacagactgaacaggcggatgaaaaaaatttttgatgaagcgagaaagaaagaagcggcagaggaggatggcaaagaattatgaataccggatattctatattttacgctccttggacttggcgcgtccggcgcggtaaggtataatacttactgatataataaatttttatggaggaatgtttttatggaaattacaagtctgttgccgggcgtaaaaattgtaaaagaggatggagaagtaaaagaagacgtttttatctcccagggggacaaggttaaagtgacaactgtggatgaaacggtgacaggtacattcatgcttgtagagtttgcacgttacagtgaagaagatgatattctccatatggtgagagatgatgaaggatttgctgttcccttcgaccagatcattgatatcgtaagagcagattaatcctctgccgggaaagtgtttttgatatggactatgcgaggctgaccattggacagatggcgaaactaaataatatttcaacacaggctttgcggtactatgaccagataggtcttttaaaaccccggttttatgacgaagacaataagtaccggtattacagtattgaacagtgtgctgtgctggacgccattatccatatgcagtctttgaaattctccttatcacagattaaatatttttaaagcccggaaagcatcaggagctgtatgacgcaatagttcccgaacgcaatgtcatacccttcgggtggacgtgcttcacacgataaggtataacaaaagaaataacacagctggaaaatgtgcaaagggttatggacagaaagtttcatgattatcaaaattcgtttcttacaaggatatcaaaaaactaatggctgacctgaaacttgtatatgcggcgccaacgggggaaactgccctgaatgagctggaactgtttcgggataaatgggacacccaatatcctaaaatctataaatcatggcatgataactgggcgaccctttccacctatttcaaatatcctgaagtggtcagacggcttatttatacgacgaatgccattgagggctttaaccggcagctgcggaaagtgaccaaatccaggagtgtgttcccaacagatgacagcctcctgaaaatgctgtatctggtaacgatggagatcacaaaaaaatggacaggccaccggcaggactggggaaatccctgtataatgcaggtatgggcagaaccaaaaacaatcggctctgcccaatcgtaactatcaacgtatcttacattagatttttgagtatacacaaaacttgaaactctctcagagatgttgaaacccggtcaaagagtatacctaagaggaataagccgtacaatgctcactataaatcgggattgcttgttatacctaaaaatagcatagttaaaccacaagtccttatctgatactttatcagagcatcgtgggtgaactctacaccattatttccgaaggtaaatttacgctatcactgatgctgttttttcttgacaagaccggccgaaagtattatattaacaatatacaatattttgtacaaaggcgttgagggtatggatcagaatttatatcagaagatcggtgttacgataggacagttggctcaggatttcctcaccagaaatgtaggagaccgtatcccttcggtttcagaatatcaggagaagtttcatgtatcacgggggacgatacaaaatgcgctggcttatatcaaggagagccagggtatatctctgaaagcgcacgggcatatggggacatatatcgaggggatcgactatgccagactccagaattgttgtatcagggaggagatactggggatcatgcccctgccttattcagtgacatatgaagggtttgccacagcggtctatgagacgatgaaaggactgaattttaatatggcgtactccagaggagccgtcggcaggatccggctcgtggaatcggggacctatcagttcgcggtatgttcgcagtacgcagcggagcaggctatgcgggagggcagcaaggttgagatcgtcatgaactttggggcaggcagtttcctttccaggcatgtcctcatgttgcgggatacagatggcacggggatcgtggatgggatgcgtgtcggttatgacagtacatctttggatcagagcaagatcacggaaaggatcatcagagataagaaagtagaacttgtagagataaagacacagaatatcatttccggattaaaggcagggacgatcgacgccggtgtctggaactatgatgatatcatagcccatgggcaggttggcctaaaagttgtctttctcagcgaagaagagtatgacgtgcggttttcggcggctgtcatcatcgtaaaaaagggagctgaatatatcaaagcgcttttggaaaaacatataagtaaagagcgtgtgctgaaagtcctggaagaagtaaggacaggggagcgcgttgcagattactagatgatgctgcaaagcagaagcaagagcattgctttggactgtctgtattgggaaatgtctgctggagcaaagacagtgccattgtcccattgcagacaaaatatatcataccaatatacaaaatattgtatattgagaaaggaggatggtttggaagtaaaagagaacctgtatgagaggatagatattttatgttctgctgacatcataacgaaagatgatgccgctgtatgcggacagatagttgatatcctcgcacaggagagggaggatgtggatgaagaaaaagcagggatctttatcacccatttggcgatggccctgaaaaggacaaaagaaggagagaaggaggagcccatcgacgcggaaatcctggaagcgcttaaagaggaacctgtttatgagaaagcatccgcatttttcggaaaagtgatgggcagacttccagtagaactttcagatgcggaaaaagggttcatattcgtccatgtctgtaatgtattgggtggctgaaatgcacagaaagggaaaaggaggaaggaacattgaagatcgcaatcggcgggatgcagaaaaatgagatgaaggacgctatcttaaaagcgtgcccggaggcggaaacgatcgtcactacggatatgggggcggtcccgatgctcaaggacggaagggcagattattattttggagcatgtgagagtggcgggggatcggcgatctcgatcctgatcgggctcatcggttatggaaaatgctgtactgtctgtaaaaacggtggaaagccggacagatctgagattgagagctttgtcgaggcgggaaagatatgttttgggatgacagtatccaatattgaagggacagtttcggtactgatggacgtacttatgaagaaagagacagaaaagtgatttaggagaaagagaggaaacagggatggagcttagcgttataaacattattttagtgatggtcacttgtgctatgacagcgtttatctcacatatgggcatggcagtatttcatgatgggataagacctgtcataccggaatatattgaagggcgcatgcacagaacggagatggcgacgatcgcttttgggctgagtgtggggttcatcgcatctgtagggatcggaaatgcacttgccacaaatcttcttaatccatggcttttattccttgccacggatatcatcgggatcgcctcgccgaagaagtggctggccccgatcctgggggcggcatatggggttctctgtatcacggcgatagggggcgtgaacaccgtgctgacaggcatgccggtagacctgataggagcgttgggcaatgtcggtacatatgtggtcacaggttttgcgatcttcccgatcatcaccatcatcatgcagtttgggatgaggacagggataatctccgcagtcgtcgtagtggtattccgtttcggggggccgaaattttctacgatcagcgcggatgcatggacgatgatggttggtgtcgtccttcttgtcgcactgtgcatttacagggatgcaaaggataaacaagacaataaagaaggagagacattaaatgtattttcggaaaggactgcaaggatcaagaaaaaccttccgttcctgatgatcgcgggagcacttatcgctgtcatatgtaatatccacgtctttgccgggagcgacgtttccatgttcgatctttccaaggcgtatgtgatgacagatgcggcggaggcagatgctcttatcaagacagtcgccacaaatgaatttatgagaggcctgagttttatccctctgatagctacgacagcagttacgacaggtgtatatggcgttgcgggctttacatttatctatgttgcaggatatctctcgccgaatccgatcattgccgcagtatcaggtgctgtcatcatttttgtggaagtcatgcttttaggcctgatcgggaaattccttggcagatttccgtctatgcgtgatgcttctgacaatatcaggagcgcgatgaacacctgtgtcgagttcgccctgctgatcggctctatctcagcatgcggtgcgatgggggcgggcacttccgcaggtgcagaaggcgggtttttgatcggtggcgtgatctatctgatcaatgaggcgacggggcggaagatcatgcgcatggctatcggcccgatcgcggccatcgcgacagggctcctgctcaaccttacctacctgatcgggcttacgccgctggtataagacagaaaagacggtgaaaagttatgataaatacagttaaaggacgtattgatgccggagctgtcggcgtcaccatgtgccacgaacatcttgccctggacttgtccccggtacgaaaggatacagactccgtatttgacgattcggtgctcatcgaaagtgaagtggatcttatgaaagccctgggggtcaaaagtgtgatcgaagtgacctgcaatgacatggggagaaatgtgcgcatgctcaggcagataagcagagaatgtggcatacagatcatcgcgtcgaccggattttatctggaagcgtatcaccctgaaagtgtccggtcggggacaataggagaaatctgtgatattttttgccgggatatcctggaagggatagacgggactgacataagagcaggtatcataggagaagtggcaggcggggagaaagaactggctcccagtgaagaaaaagtactgaaagcggctgcggcagcaggggtaaagacaggatgtgccgtgacgacacattgccagctggggcagctggggctggaacaatctgccttgctgcaaggacaggggatagatccggataaggtcattttaggccatatcgacctgtcggacgacagagcctatcagaaagcgatcctggatacgggagtgaatatagcatacgatacagtgggaaagacagcatatctgtcggacgaaaagcgggcggacaatctgatgtggctgcttgaaaagggatatgaggaccacatcctcttatcccaggatatctcgaggagatcctatatggtgagatatgggaagtacgacggctataccactgtcatgaaaagatttgtgccacttctcagggaaagaggcgtgtcacaggaaacgcttgacaagatgctgatccataatccagccaggatccttgatatgtagaagtaaaggagggaaatatattgctgacttatccgttggaagggatggatgtaaaagaagctgtcgcggcccagtttaagatgatcgattgtatcacgaaagtatttcgggggcatgagatgctgagcagaggagatctgggtgtcgtgcctggtttcaataagcctgtgacgacatataaggcagaacaggtcatcgcggacttttttgatgcggaatcctgcgtccttgtacggggcgcaggaagcggcgccattcgtctgggcctgtctgccatgatgccaccgggcagcaagatattgattcatgatgccccggtctacagtacgacttccatttccatggaaatgatgggactagatcttaaaaaagcggattttaacaacctggcagacatagaacgggcattggggcaggatccggatatccggggggccctaatacaatatacgagacagaagccagaagacagctatgatatggagactgtgatcgggaccatcagaaaatgtgcggatatcctcatcttaactgatgacaattatgccgtgatgaagatgagcaggaccggagtgcagtgtggcgcggatctttcgtgtttttcctcttttaagctccttgggccggaaggagtggggatcgttatcgggaagaaaagatatacagacaagatcataggatggaattattccggggggatgcaggtacagggccacgaggccatggatgtcctgcgcgggctgacatatgccccggtgtctctggccattgaagcagaggtggggaaggagtgtgtcagaagactgaaagccggcgagatagacgggataaaagacgcctttctggcaaatgcgcaatctaagatcgtacttgtagaatttgaagaagatattgccgctcaggtgttagaagaggcagaaagatccggcgcggccccaaatccggtgggggcagaatcgaaatatgagatagtgcctatgttttacagactctccggcacattccgaaaagcagatcccgctctcgagaagaggatgatccgtatcaatcctatgcggggaggcgctgatacggtgctgcgtatccttaaaagggcggtagaaagtgtgaagatatgtttgtgaaccagttgagaaagaagaatccggcactgttaaacacggcgtttgaactgcaccagacgggccgggtcagcccggattcttacataatagatgtagatacattccttgaaaatgcgcggaatatcgcgaagacgggcaaagcatacggcataaggctcttctttatgctcaaacaagtcgggagaaatccatatctggcaaagagacttgtcgagatgggatatgaaggggcagtgaccgttgactataaagaagctgaagtcatgatgcgccatggcatccccatcaaaaatgcgggccatctggtgcagatacctggccataaagtaaaatgttttgtggcttatggggtggaatatatgaccgtctatacccgcgaaaaaatcgaagagatacaaaaagccgccgcggaacttggaaagatacagaaaatattactccgtgtcgctgcaggcggtgacatgatgtattccggacagaccgccggattttcgctggaagagatgaaagagaccgcgctttgggtggagaaagactgtaaaaatgtaaaagtggcaggggtcacgtcgttcccgtgctatctgtatgactcagaagagaagaagattcggccgatccataatctgaagaccgtgttagaggcggcatcaatcatggagaaggcagggatgccgtgtgaacttgtaaacacgccttccgcaagctgctgttcgaccctgaaaaaaatggcggtctatgggggcaacagcgcggaacccggccatgggctgacggggactacaccacttcacgcggaatgtgatgagccggagatcccatgttgtgtatatgtaacggaagtatcccacaattttgagaacagaggttactgttacgggggcggatattacaggcgctcccatgtggaaaacgctcttgtggggacggggatggagaagatggaacaggtttctgtcatcccaccggacagtgacagtatcgactatcactttgggctttcgcagatgtgccaggtgggagataccgtgcttatggcgttccggtttcagatatttgtgacgcgaagtgatgtcgtgctcgtggaagggcttcacagaggagagaaaaagatcataggagtctatgacagtcaggggaggcagaaatggacaaaagattcgtagtgatcgtgttagacggcttcggcatcggtgctatgaaagatacggcaatggtcaggccagctgaccagaaggcggatacattggggtctttgctgcggaggtttcccgaactgagattaaggaatctggagaggctgggactgatgaacgcctatggaaaggagagctcatgcatgaagtttgcaccttgcgcaaacttcgggaaatgtgagctgatgcattttggggcagatacgtttataggacatcaggagatcatggggaccctccccaaaaagccggatcagcatccatttcaggagaaagccgaggagatacgggactgtctggaaaaagcaggatatattgtcgaagtgatcgagaggaaagggctcagatatcttcttgtcgacgaatatgccactgtggcggacaacctggaggcagatctgggaatgtgctataatgtgacggctccgctggattatatgccctttgaaaaagaacttgagatcggccggctagtgaggaaggttgccacagttggtcgggtcatcgtatttggagggacaggcaatacgatgcaggatctgtgggatgccgaagagatcagacaggggaggttcatcgggatagcgtcttcaaagtcaagatcttatgagcatgggtatcagtgcaggcatttaggatatggcgtggatccgcaggtacaggctccgtccattcttggcagggcgggatatgaggtctcgctgtttggaaaagtcgcagatatcgtgaataatgagtatgggaagagcgtttcctgcgtggatacggaagaagtcatggaacttacgatcagggagatggggcggatgaaaaagggatttatctgtacaaatgtacaggaaacagacctggccggacattcccagtcagcaccggcttacaaaaagatcctggagatcgcggaccgcaagatcggagaacttatggagtgcctcaaaaagcaggatatcctggtcgtgatggcggatcatggaaatgatcccgagatcggacacagcaaacatacaagagaatgtgtccctttgctcgtatataaaaaggggatggaagggacagatcttgggataagaaaaacattgtcagatgtgggggcgacagcatgtgcctgttttggcacacaactccctcagaatgggatgtcgtttatgtcccctgaaggttaaaaaacggggcagactgtttttaaagaatacctgaatgaaaagttaaaatccgcttgtaaacttaaattccgtattgacaactaaattccatttttaaggctttgacagatgtcaggaatgggtataaagtggaatttagttacccttgaccattggctgctaaaaaaagggtatgcggttgcaagcaactgggattgtgtactgtaagactgaattccacctgcctaataggttattatggtggctcgtatccgcagatttattttattgttaggcattcgtcacagggtaattaaagtgttggcacgttgtgccagccgagcatggatgcccctactgtaaacacatgaaataccagcgtcttatgcctgcgtgttacgcattggtttctgcttgccgtttaccagtgccggcgtaaggatgacttcatccgccggaatttcagacagatggaggaagtccatgagttcatcgggcaatatcatttttgcaagtgtgaacggtgtcagaccgccgagactttcccggcaggaactgttaatgtggctcatcatcaggttcacgtcatcctgtgtcatgttatcgaaagagctcttgccctgcgggcagattttccggatgtattcgtggttccgctcacagtgcggtttctgccatgaagccatcggatcacaataatagatccttgtgcggatgatattgtcaatgccgcattcaagcttgtccggatgtctgaactcgcctcccctgccggtaagtatcagggggattgcggtgctgaaaagccatgtaccgataagctttattgatagagtcaaacactttttcaactcctgtggtttccttggagtccaggaggaacgctgccataatgtcacaggaacaaaagtgcatggtcaggagaaccttgcggctgccctcgcatccaatcaccgtgtccatttcggtaatgcgggtgtcaactttttttataccatatcattaaacaggtttatgacattggtgaaacaaagactgcacattccaaacgtgaagtgccactgaccgggagagctatgttagtattaaggcttttaaaggaattgcatcagcaaaatggatggtataaaccaaatcaactgctttgctatgatgggcatcaatatatagaaaaaacagcaaagctttctaaagatttaaagaatttatgtgaaagagccggggttgaacctgacagagtacatcctcatctgctacgcaaaaccgttgcaactgtattacatgaagctggaatgagtaccagagatattgcagatatacttggtcattcggatatcgcaaccacggaacaatgctacatcatttcaacagaagcggaaaagaaacgaaaaaaaatggcggcagttttataaaaactatcgtcattttttctttaaaaagtgtccaaactttttgacatcaataatttaattttgacagcagtcagatttactatttaaaccgatgaaaccatgagaaatactagattttccagcattaaaaagagcgatagacgggactcgaacccgcgacctcaaccttggcaaggttgcgtactaccaactgtactactatcgcatattattctgaagttctttgctgagaacaaaatatattttacaatattagagcaaggatgtcaaccatcttttttactatttttttgctgtatgaaaaaatcaattatcggattgacaaaaaaataaatataagttaaaatatggaaataagatatcttatatcaaaaatacagctaatcatttctacatctatttcaagataaaccgattcccattgatcaggaggaactatgcagaaatttgcaatcgaagacaagtattttggaccgctgctgccttttatccaggactatatggttaccgacatcaactggaatggaaaagagctgatcattgacgacctggaccggggcaggcataccgttgttggaacagagatttcggaaagctttatcagccagttcagtgcaaggatagccaatgcggtctctgctccgtttaataaatatgatcccttggtggaggcagaagtagatggactgaggatttccattatacatgaagatgtatgtgccaccgggcggagcatttctataagaaagtcaccggcacttgtaaggctcagcgaagataagatttttaaagaggattactgcggcagagaaatcctgaatttcctgaaaaacagcgttctcggacatatgaatattgtgatcgcaggtcaggtaggcagcggcaagacagaacttttgaaatatctgaccaggtttattccggacatggagcgagttattacgattgaagatagtctggagatacattacagggagattaatccgggaaaagactgtgtggccattgaggtcaatgaagatacttttggctacgtagaagccattaaagcgtctttaaggcagctgcctacgtggattcttctgtcggaagccaggggtgaggaagtacagcatttaatccagtccctcacaacgggacactattcgctgacaaccgttcacacggatgatgtgcggaggattccggagaggatgaaaaatatggtggacgatcccatcgcatcggaacgtatagagagggacgtctatggatttgtggacttgggaattctgatacggaaggaacagagcctggatggcagaatcctccgctatattgatcagattgcctgtttctatctggatcagaatggacagaaaaagatacagatgatcttgaaggaccggaggattataaataaagagcttccgcagaagctgaagaaaaaatttctggtcaaagatccgttccgatgggaggggatgaacaatggaacaacgtaataaaagagcaatcctgaaaacattctggtacatcaaatatacaaatctaaaaaaagagatccggggctatggatacttttattcattcaaaaaatatctggcatctttatttttatcttttcttggaattcttttggcaggaagattttttcatctgcaaataccttatatcatgggtctgggcctggcatatctgtgcttttttccgatcattatcatccggcagtttaaatatatgtatgaagagcaaagattcagggatgtggtgaattatttggagcagatgatatattctttcaaaaagcagccaaagattatcgtggcattggaggagacaaaacagctctgtgaaggccgtattctgaaacttatcgatgaagcggagaaagccatcagcagtccggtcgcagcagacgacttgtatcggcacgcactttcctgtattgagcaggagtaccgctgtgaccggatgaagatgctgcatgattatctggtcaaagtggaaaatctgggtggccagtatcaaagtacgttaaatatcatattagacgatgttaaagaatggacagagcggacgtatctctttcagaaagagagaaaaagtatgaaatttaagatcgtgctttctctgaccgcgtcgctggcagttgcggggaccacagtcatgatgctggccagcgatgagatgcttggaaaggtacttaggggaccactttaccagagaacgacattttttcttttgtttttgtttctcatgttatatctgggagcacaaaaactgctcaccggctcctggctaaaagatacgatggaagaaaatccggaacagattcaaaaagattttaagataatgcgggaggaaaaggacggaaaacagccgtggatcattactgcactgagttttcctgttttactcctggggtttgactggcagaatctctatattataggggctgtaacagccctgatagccgcggcgtggttcactccgtcgttaaagagaaagaatgccgggaggagaattctaaaagagatcaatcagaagtttccttattggctcagggggatcgcgctgagtcttcagacagaaaacgtctatgttgcaataagggattctcttgataaagcaccttatgtattaaaggagcagattgagatgcttctccataacattgatgaagatccggaatccatactgccgtatcagaactttctgtcggagtttgatctgccggaaatacagtctgcctccaagatgttatattcgcttaccaactgtgggaaagacgattccgaggcacagatcaataccctgatccatcggaataatgtattaatggacaaggcagaatggattcaaaatgagaacgatgtagcggggataggggcattgacgtttgtgcccatggtgctggcaactttaaagatgatcatggatttgggattgattttcgggagtttctttacgctttggacgaaacttccgggatagacaggaggacatatgcaggatttttttgaggaactgggagcggttttatttttgctgcttacaggcatcggtatctgtgcagtttacattcgttttgttcagctgataagctgaaaggaggtgacacctatgaagacaatcattgacgaatatggcagcataattgtgtgtgtgatcgcaggaaccgctgttcttgcatttctgggggtattattatctgctgccgcccggtttggaacagccttttttgactctatcagctgtgtattgtgttaggaggatgaggtgaagcagatcattgaaaattacggaaggatcattgtattgatagcagcagcttttggagcagttttccttatacgaaatacagtctattcacagctgaaagcaaacggcgttatacaagataccaatcatatctcatccaatgaattttttcaaaagcagggcagaccggagttatcgggtgttcgtggggaagacggtacggcaagaagactcattattagaaaagaagagcagttgaatccgagaaagcttgtaaaggtagaggataaaaaagacggtgacctgacggaaaagatcaagatttttgttgtcacgaatgagggaggaaaagaggtgaggtctttgtttgagtcagaatatttagatacgagccatgataaggaatttattcttttatatacggttaaaaactccatcgggctggtttcggaaggaagaattaagatactggtaaagaattatggagaaaatcacagtgaatgaggatgtaaaacgattccttatttatttcacgctttataggatctgcggacagctgtgcagtttgatcggaattcctggcctgtatccaaatctgattagcggcctgtgtctgatccttctttgcagaccctttttgacaagtaatcaagggaaaaggttcagaatccgcagcggactgattctatttacgatttctttcttttttctcacacaatacatttctatttatcttactgaaaatttccataacagcaaatttataatggatcagagggccgagataagcccgctcttagtaaacgcagctgcggcaggaatcattggaccggcagccgaggaacttttattccgcagatttctgttcgaaggattaaaaccgatggggaaagtaaagtcgtctctgatttccagtgtcattttcgggctgtgccacagacatgtgatccagggtatctacgcagcattgtgggggaacgtcttttgtttcgtatatgagaagcatcacagcttaaaagcacctttttcagttcatatgatcagcaatctgctgtccttttcaccgatcctttggatcagtctgaatcatttttgtcttaccgtctgtattacttttatttccgcatggaccgtctgcctgacgataaagaagaaaggggaatgtttatgaagatgcctgtcgaattagtcatcagtgtgattctgctctgcctgggtgcctttattatggcttcatataatggagcggctttggaagaggccggagcgagagccgttcatgaggaaatgataggcagaattgaggccagcggctttgattctttgatcattaaagagtgtgaaaaagaggcgtctgaaaagggatacagtctttctgtaaaaaatgacggcttttatgatgaaaagccaaagtataaagtagtgctggcttatcatctgaggataaaactgctgggaattgccagctggcaggagattgaagggtatgcattatgaggaggatagaaaatgaggctggccgtagagacatttgtatgctgctttattatagccgcaggaatgtttttaaatgtcgtttattgtgtcaatacgaaggtggtctccaacgcaaagcaataccagtcggccgcagtccataagatggatgcggcgggtttttcaaaagcagtggttgagcaatgccggaaggaggcaaaggaggacgggtatgtttctttggatgtatccagggaacaggccgacgagaacagggcacgctcttttgtaacattgaagtataaattatatgtacctctgctgcggatagaaaaggtttgtcagatcagaagctatgcaaacagtgtaacagaggatgaagaatgactgaaaggagttacttatgaaaagttttttagaagattacggattaattattgtagcagtgattgtagtgctggccttatgtgtttttgccaaaggtacttttgtgacccagtttcaaaaagcgctgacggataccatttcaacattttttgaaaagtcaggtgcgaacagctcatttatatttctgggatgacgcagtgagggataaagcagaggaggaattttatgaaaggggcagtcacaggaattattttacttgtcatcttaatctactctgtgtttataacacaaaatatttcaggactcgcatccagaaaaacagaacttacgatggatgtctccaatgcggttgaacagactttggacaatatgaaggaggaacagtacgaatccagagagcagatggcagaggcatttgtccgggatttaaagacacagattacgtcagatgccgatatagaagtggaaattatcggagccgaccatatccacggactgctggatgtcagtgtccgtgagactttccttacttcagacggaaagaaaaaaacaatagaggtcagaaaaacagcagtgctggaacagtttcaggaagaagcataaggaggcatgtcagaatgaaaaaatgggggaaaagaattatttccggtgtgatcgtagcaagtctgctgacggcggctgcgatatcgggatcagaacagggcacagccacagtgtcttcagttgttcaggccggcacagagatgagttttatggggaaactgcttgaaggtggatacatcgatgtattcacctcctggtctcaagaagaacagaataaattttatgacaggttaagtcctaaggaaaagtctgtgtttttggaagtgacaaactgtcagatcatcagagaacttataaaaagtgaacggacaaaagaggagttagaaagattatttgaccggctggagccttattttctgatgctgaaaaaggggagtcaggagaaaccggatgaagagattgttattgagtgtataaatcagattgagggaaaagattatgaatctttagaacaatatttaaagcagctggtatcggagaaacatggttattatctggatttttacactgctctgaaacgggtgaaggacgggaaatcagaaatacagagtgcagtgaatgatttatataaaaaccttggctttctcaaggaagacaaagttcctgctaaaccagacaaagtatctccgctgcctgttcaggtacagaaaaaagcagcgaaagctgtttcagatggatattctaactttaaagccgtgagttctctcaaagctttaaaggacgcagtggcttccgtagagaaaggcgagaaaatagcagtccgtgtggataagggctttaatgtgacatcagcgatcaggacgaacggtcggcatgtgaagatttatgcagatggtgagagcgcacgtaatctcaacagggctgtgggatataaagatgccatgttagaagtaaacggagggtcactcacattaggagcctatgacggagatggaagagcaaaaaataatctgtacattaacgggaaaaacgttgctgcgtcagctcccatgatagaagttatatcaggacagctgtatctaaataaatacagccgtatcatagacggatattttttggcagactttgcaggaggggcaggaattgccatgaattccggtacatcctgttatatgttcggagggaagattgacagctgccgggcaaagagcagcaaagacgtgtcttccagttcgccgaaatcttcccatggaggcggtgtcttggtcggcaatggtgcttctttttacatgtttgcagggtcgatagaacactgccaggcgattcatggcggaggcattatgaattatggaaccctgaggctgtatggaggtacagtttcagactgtgcggcgtccaacaaaaagaaggatgctctcggaggggcagttaaagtgcagggagcgatcgaaacagatggaaaagtaaactctacgaaaggtgatctcggcgtctggaaatatacgagatccggtacatgggctgtgaatggaaaggatggatatcagcagaaatccaccacaggcgtggtattaaaaaataatcaggcggatgcaggcggagccgtatgtttaaacaacggttcaaacggagccatacaggactgcaatatttatggaaatcacagcaacggaaacggggcaggcatctgtctgtcaaacggcagttacaaaaagggggcggctctggaaataaaggcaggagcagtaatccatggaaatgaaagcaaaggctatggaggcgggatttactgtgcagattctgtgaagggctccctgagaggtggaagcatgtatgataactcggcagtatatggcgcgggtgtctaccatgaggcagaattccgcatgaccggaggaactgtaagaaataatcattctggcaattctgggggcgggatctatgcaaagggaaaactttctatgacaggcggagagatttcttccaatactgccgccacatatgggggaggagccatcttgaaaaatgcaggaggctctttgagcggaggaagtataaaaaacaatactgcatctgtaaacggtggaggacttcagatagacggagcagtctcattttcaaatgtatcggttagttccaacagcgcttccgggaagggcggcggtatctcggtaagttctgccggcacgtgcagttttagcagcggcaatgtcagcggaaacacctcaaaggcaggcggagggggtatttacattgacggcacctgcaaggcaaacggaagcaattttacaggaaatcaatcttatggagacgggggagctgtttatatagccagcggtacttttacaacgtttcaggctaatcaggcagtgaacatccagggaaacagtgcatcgggaaatggatcaggcatttataacaggaatactgcgatcctgaacaacaacgcccatatcttaaacaatcagtgcaaaaatggtacacaacggagtatctttcatgaaggaagcctgttttcaatagagggacatacggagatacaacaggaaatttatctcgcaaaggatcggtttattacggtctccaatcgatacttttccaacagcaattcactgactgccagaatttctcttgatgctgccaatatacgaaatggctatgcggcagtaaaaggaaacatatctaattctgcggacagtaattataaaacaggagatgcattgctgaacaatcagtctgtgaatggaagatttatgtatgcaggcagtggatatgtcatgagaccgggaaatttaaaaaaatcatcttccggctgtgttccatacagcattgttctgagtcaggcatatcagattcgctatgataaaaattcaaaagaggaggtcatgaacatgcccacggcagcagttaagtattgggaggaggacataaggctgtcggctttgacaccttccggtggatcgggcgtgtttgttgcatggaatacgaatgcagatggaacaggagacgggtatcagccggggaatgtttatacagcaaatgcggatgcgacgctttttgcactgtggccccattacagggtggagtatctgccggggattcagggtgccgctggtacgacggacagccaggaacaaaacaaatctgaaaatatactgttgaggaaaaacggtttccggtcatcagaagggaagtttataggatggaaacaagatatcagcagtgcccgtaagagaagagaattggaacctgttggatataaagaattaaaagaagagcgggaaagggggaaatcagatcatatcttggcatttgcaaaaagctataagaaagtaaatgcatctgtgaatttagataataaaaatagcttattgaatgctgaggatatattttttatggaaggccagtgggacagtaagccagacattattttgcatgataaaaagacttttttagagaatgaaaaaataagaaagaatgatttattaaaagctgtaaagggttgttatgatgatgaagacggagatttgacggaaaaagtacagattataaaattagattatggaacaagtatggaaggataccggccggaaccccaaaacttttctggaggaatgaatgatacagatgtaatggacacttattttatgaagcttgaaaaagatgagaccgtagaagtcaaagttatttttcaagttgaggacagtgttggaaatgtggcagaaaaagaaggtacggtatatgtaacttataacaatcctcccaaattacattcacagaatcttgcattttatcagaaagatttggataacaatccacaaactgttcttaaagaaatacttgaaaactatcaggtagaagacttagaggatgacaaaagcggcctgaaagtacctgtatctgttgtcgatccgataccgatgcaaattgaaaagttaaattccgtaggtgagcataaaattgtttatcaggcaatagattctttggggaagaaaacaaaacttgattcgacagtatacatcgccgagaacaatccttttaaagactcatataaatataatgtaagatttataaataagaaatatttgtatacgttgaaagagtcgagtaaatggaagaaagacgggaaattaaacgctcagctcacaagccagctggaaaaaacaagggaagatgctgtgttaaaatatgaatttaaaatcaagaaataaatagacaggggatagcgaaagttattccctgcaattctcaaattagtacatagaatttttttacttattttgccatgatatatttatgagagagaagatactaaaaactatatcatattaaccaggtggagatgttatgataaaattatattagtatcttgtttatttgtaatagtgatttttagtaattagaagcggaatgacaattcatggggaaactagttacgccgaaaccatcggtgagccagaaaggaagtcattggaaaagggagttatacaggaaagattaagcggtattttgtgatagttccaaagaaagcacaaatcaggaagataaaagccgggaaaaagcaggcaaaagtctatgtcagaaaaagtcccgggaagccaagcggttatcagatctgctggtcagcgggcaaaaagttctctaagtcgaagtcggtatctgctgccagaacagccattttggaagttacagcccgagaaaaagggtgagagcaaaataaaacgggtgttatcccagaattgccagggaaaacggatgaaagtactgccctgtcttggtataatggaatatatatcagttatataaagagaaagggatggagcatatgagagcctttgataaatggcggtttaggataaaaccccaaaaaatcatttttttagatatcgacggtgtgctgaattctatggaactgtttgataaattggaagaaagtaacatcgagccgttcatgggcattgatgtggatgaagataatttagaacaactaagatatatagtggagaagacgggggcgcagattgtactgtcgtcaagctggcgccatgcgtggcatgagaaagggccgttgatcagggtggggagagcattagatcaggccatggcttcctatggcatgaagattatatcaaaaacaaaacatctccataagggaaaccgctcactggaagtaaaagactggatgcgtgggaaacgcatccggtctttcgtgatccttgatgatacggattatgattgggaagagaacagcctgggagagcactgggtccgcacaagctttatggaaggcgggcttacaagagaactggcccaaaaggcagtgtatattttaaatcagagttcctaatccaggataatcccttctgtagaaatggtaatgacattgagcggaatggattttttactctgttccagggcagtgcgcacggcatattccagccctccgcagcaggggacttccatccgggttacggtgacgctctttaaattgttttgacgaatgatttctgtcagcttttccgagtagttcacagggtccagttttggacatccaactaaggtgactttctctttcataaactgttcgtggaagtttccgtgtgcgaatgccgtacagtcggcggcaaccaaaaggtgggcgttgtcaaagtacggggcgttcacaggcaccagttggatctgaaccggccattggcgcaacgcactcttgttattttttctttggtttttaaggactgcttctttgtcatagtccggcgcttccctgtcttcaaaggagatcgcaccggtcggacacattggaaggcagttgccgaggccgtcgcagtaatcatcccgaatcagttttgcttttccgtcgatcatctgaatggctccttcatgacaggcagaagcgcagagaccgcatccattgcacttttcctcatctatttttattatttgtcgtatcattcttatttcctccttgagtttgtaatcccatcatactataatgagcacaagttgtctgttgataaatcaacacatttataggagatgtgaaaaaatggagcaaattttataccgcagtcccctgttccgcggaattaaaaagaaggatttagaagggatgctgggctgcctgtcggccagaaaagaaacgtatgcttccagggatgccatctgtctgaatggagacaggatggaagaagtggggatcgtagtggacggggaagtccggatcgtcagagatgattttgagggaagaagagcgattcttgcccatatcgggccgggcgaagtgttcggggagacctatggctgtcttccggatgcagagctgcctgtatcggttgaatgtgtcagagattgtacggtgttgttcttaaactaccataaggtactgacgacctgcaatgccagctgtgcattccaccagcggctgattgaaaatatggttgttcttctggctgaaaagaatgtccgtttgaatcaaaagctggaatgtcttgaaaagaggactacaagggagaagattcttgcatatataaatcaggaacaggataagcagaaaacgtcccggatcaagcttcctttttctaaaaaagatatggccgattatctgtgtgtggacaggagcggaatgatggtggaactgaggaaactccagacggaaggtgttttgtctgttgagaaaaatataattgcgattggagagagacagaatgaagatcagtgacgtaatgacaaagatgatagagtattatcagggagattccaaaagagtccagcactttatgaaagtgtatgcctatgcaaaagctatcggggagcaggaggaactggaaccggaactgcaggagatcttggagattgctgcggtgactcatgatattggaattaaaaaaagtgaggagaaatacaatagcagttcaggaaaataccaggagatagaaggaccggacgaagccagaaagcttctgggtgagttcggtctgaaaaatgaaaccatggacagaatctgttatctgatcgggcatcatcatacttacagccggattgacggcatagattatcagatccttgtggaagccgacttccttgtgaatctggaggaggataagagcggaatgaaagccgcgcataatgtgaagaaaaaaatatttgttaccaaaacggggattcattatctggaaaatctattttttgaaagatgacaaaaaatctaaaaaagttcttgatttgggctttttgatatggtaaagtatagaagtcgcaggaatgagacatgcccagatagctcagtcggtagagcagaggactgaaaatcctcgtgtcgctggttcgattccggctctgggcattacagagaattgaaaagactctgtcatatatgcgggtgtagttcaatggtagaactccagccttccaagctgatcacgtgggttcgattcccatcacccgcttagcaagccgttttagagatatctctaagatggcttttttctttcttccgcggcagattataccgggcctgtaaaagatgcgggatcaaaagagcgaggaaaaggagaggatcgttcatggaacttacggtgagacagtttaaaaaagaagatttagaagagatgacagcgatatggaatcaggtggtagaagaggccaatgcgtttccacaggaagattttttttctttaaaggaagcagaagatttttttgcagggcagtcttacactggggtggctgaatcagacggaaagattcttggcctttatatactgcatccaaataatgtgggcagatgcggacatttatccaatgcgtcctatgcagtcagcaaggatgcaagaggccggcatatcggagagcagttggttttggactgtatggaaagagccagagagctgggatacaaagtcctgcagtttaatgcggtggtagcgtccaatcagggtgcgctgagactttatgacagacttggatttcagcggctcgggacagtgcccggaggctaccgtttgtcagacggcagatacgaagacattattttattttacatcacactgtaatataataaagaaaactatagatgaaagagattcataaaggagaaggtcatggattacaatgaattggcgctgaagatgcacgaagaaaacagaggaaaagtggcagtaaggtcaaaagtgacggttgagacgagagaagatctgagtacggcttatacccccggagtggcagaaccttgccgaaaaatcagggactgcaaagaggatgtgtaccgttacactgcaaaaggaaatttggtagctgtagtttctgatggaactgctgtgctcggtcttggtgatatcggaccggaggcggctatgccggttatggaaggaaaggctattttatttaaagagtttgccgatatagacgcatttccggtctgtctggatacgaaagatacggaagagatcataaagacagtaaaatatctggcgcctacattcggagggatcaatctggaagatatctctgcgccgagatgttttgaaatagaacgccggctgaaagaggaactggatataccggtattccatgacgatcagcacggaacagccatcgtcgtggcagcagggatgatcaatgcgctgaaatttgtgggaaagaagctggaagatgcaaaggtagttatcaacggagcagggtctgccgggatttctatctgtaagcttctgcttcagttcggagtaaaagacgcggtgcttgtagaccagaaaggtgccctgtgtccgggggaagagtggatgaacgatgcacagaaagaaatggcggaaaaaacaaataaggacaggcagacaggagaacttcgtgagatcatgaagggaaaagatgtgtttatcggcgtttctgcaccgaatattgtcacatcagaaatggtcgcttccatggcaaaggacccggtagtatttgctatggcgaatccggtgcctgaaatcatgccggatgaggcgaaaaaaggcggggcaaaggtggtagctaccggccgttccgattttccgaatcagatcaataacgtgctggtgttccctggaatcttccgcggggctttggatgccagagcttctcagattacagaagaaatgaagatggcggcggcccgggctatcgcgggaattataacagaagaggagctcagcgaggattatattattcccggggtgttcgataagcgggtatgcagtgcggttgcggatgcggtaaaggcagaaagcagaaaataaattaatggttgtaatttttgacgaagtcttgtaaaatatgtagtgcactacatatggaggcggattatgaaccaggatagggaaatcggagccagatttaagcatatccacgataagtttactcagcatatgaatcagaaactgcgctgtctgaatgtgacttattcccagatggaactgcttttatatctggcggaacatcagaaccggaagataacccagaaagatatcggagaattcatgagagtgaaacattccacggtcatcggtattttaaggcgtctggagacgaaaggatttttgtactgtgttgtggatgaagagaataagagatgccgcaatgttattcttacacagaaagggctggatttaaaaagtgagatggaagcccatttaagagaagaagaaatgcgcatcagaaaagcattgtctgatgaagagtcacaaagactctgtgaattgctcggcaaagtactcgaaagcctggaatgaagatataaaacagcagatgaaagtgccctgcggcgctttcatttttattccaggaggagagtttcataaaagaaactctattatattctatcatgtagctggctgcatttacgataaaaggaggaagaaacaaatggataataaagtatttgaatcatatccggtgccaaaggcagtggccacgctggccctgcccacagtgctgagtatgttggtaactattttttataatatggccgataccttttttgtgggacagaccggagacccgaaccaggttgcggcagtgtctctgacgacaccggtgtttatgctgctcatggcggtaggaaacatttttggcatcgggggatgttcctatatctccaggatgcttggagagggagagatggaaaaggtaaagaagatcagcagtttttgtttttacggaagtattatagccggtgtcattatgatgatcgtctttctgggagggatgccggtcattctgaaacttatcggatgcagccccaacacagaagaatatgcacggagctatctgacctatatcggtctgggagctgtatttgtcgtaatctccatggcctttaacaatgtggtcagaggagagggagctgcgaaggtttcaatgatcggaatgatgatcggtactatcgttaatatcgtgctggacccggtgatgatactcggcatgaacatgggagtcgcgggagcggccatcgcaaccatcatcggaaatatttgtaccgtggtgttttatctgttcttttttgcgaagatgaagacagggctttcaatctcaccgaagcactttacggcaaaagaaaaaatcctgtccggtgtatttgccatcgggattcccgcatcaatcaataatatcctgatgagcactgcaaatattattttgaataattttctggcatcctacggcgatattccggtggcggccatgggtgtggccatgaaggcaaatatgctggttatcctggtgcagattggactgggttccggtgttgcgcctctgatcggatactgctacggagcaggcaatctggagaaaatgaaaaagaccatgaagttttccatggcatgcaatgtgatcatgggaacggttctgtcgctgctctatctgttgtttacggagccgatcatccaggcatttatcaatgacggatcggtggtagcccatggtgtgaggatgctgagagtcttaatgatctccggcccggtcatcggcattatgttcgtctttatgtttgggttccaggcgatgggaaaagcaataccgtccctgatcctgtcgctgagccggcaggggcttgtattcttcccggtcctgctggtcacaaattatttgtttggacttgaggggatcatatttgcccagcctgtggcggatttggcgtcactgggtgtttcatttctgctgtttataaagatagcaaaagaattaaaggaaagagaaaaagaactggaattacaaaaggcggaagcataaaaagatccacggaattggtattaaaaccattccgtggattacttttttattcaatttcttctgtctcgatcataaatttgacactgccttttgtgccttttgcttttttggtgaaagtctggtatttatctccctgttttaccgtgtcattgatccggtccagagtattttggacgtcatggtccatgatgtttaccagacgctggatgccgtcctggttaaactgaatcaggcccgtattgagcgtgtcggcacctgtgtacaatgcgtctgtgccggaggaaagtttgctgccgccggatgccagcgtgccggtcgcagagcttaactttttgccgccggatgctgcagtgtggattccctgtccgagctggtttgttccggataccagatcactctgtccggatgagagatctccggcgcctttattcagtttcactgccgccgaacggaggctggatgcagcagtggtcagttctctggtgtccaggctgtttaattttttaaaggatgcctgagtggacggatcgctcagtttctggatcaatgcctttgcgggagctaaggaagaggataaagccttgctctgctggtcgatggtatcattctcatccttcattttgccctggatggcctgcatggttccaattgctgttctaatatcaccaacatcagcggaatcagaaactgttcctctgccgagcatagcggtgaggctgtcgatctgtccctgaagtgcctggctgtactggatgttggcgcttttgatagtttcaaaagaggaagtaatggagtccagtccggaagcaagctcctgaagtttttgccggctcggaaggctgccggtcagagactttatgttttccagtccggaggcgagctccttcatcatagatggaagagactttgttttcttctccagttcgctggtccctgcctttagatccttggtgcctttgctgagctttttggcaccggaaataagatcatcctttttatcatccagagtatttaagcctttggacagttctttggttttcttgttgaggactgcggtgccgtttttcagagttttggaagcatccctcagctccttaactcctgagagcagttccccggaaccgtttaccagtttctctgaggcattggagagggtggtcagagaatcattcagttcatcaatcgtatcaactttatccaggccgaactctgagagagtgtcggcagaagccacggttgcggtcactgtcatctggaagtccttcacatccgcggtgaattcaaaggaatccggaatatcaaatttttggccgatggcactgtcttttagcttcaggctgtcagacagtccggggaaggctacgcccatgagaatgtgtttgctgccgtcggaaatatccctggcgttttccatttttacgtttgagaaatgctctgtgggcagaataacagcggtgatcatggtaaacggcgtatagatcccgttatgtacatcatggtttgtaaactcatagcgtacccgaacttttccgctctttcctaccaaatccttcgggctgatttctttgccgtccaggtaataagtcacctgcatggagaccggaagttctttgtcagtctttccctgataatagatgtcattgccgttggcgtcccaggtgatgctgtgtttgctgcccttctgaaaagtctcgtcgcctttcacattttcaatgtcatttaaatcggtagcatctttgatttttgccgatttctttttgtttttcagccagtcgctgacaatgaccgtctgtgtattgccttcagcgtctgcttttacatagacagtttcctctttttcctgggaatcagccgcatatactggagctgcggccattgaagcgcacaaaaccagtgaagctgccatagccaaagccttgctcaatgtctttttcctcatgtttagtcctcctttatttcctgaatatggcccatgccaaatgttgtcctgcaaatcaatttatcaaatatcataaacatcgccggaaggatgcacacaacgctgaccgtactgatgacggctcctctggcgagcagagtgcagatagaactgatcatatcgatcttggagtaaagcgctactccgaacgttgctgcaaaaaagctgagtccgcttgtaataatagaaagcatggatgtctcatgggcgatgcggatggattttcgtttggtattcccacggatgcgttctttctgatagcggctggtcataaggatcgcataatcgacggttgcacccagctgaatggtgcctatgacaatgcttgccacgaagggcagttcctctcccgtataatatgggatcgccatattgacacagatggcaaattcaatgacggctaccagaataaccggaagagatgccgatttaaatacgatcataataatgataaaaatggctgcgatcgatgcgatgttgacattgcggagatccacatttgtcacatcggcaagatcttttgtaaggggagcttccccgatcaccatagattctttgctgtaactttttacgatggtattgatcctggcgatctgccggttgacctgatcggttgctgttttgtagtcagaacagatgaactccatctcataatgggggctgatcagattctcactcactgtgcccgggatcatatcggtcgggactgcggaacctaccacggaatccatgcccaggacccatttgactccgtctacctgttcgatctttttctgcatctgagacttttcctttgcagacatgccggattttagcatgaccatatggatattgctcatatgaaaatcgtcgctcagtttcttatttgcaacgttgctcggaagagactggggcagtgatttatcaatgttatagtagatctgtgtgttgttatttccgtaaacggcaggaaacaaaaggatcagaaagatcaaaaccgctgctttgtaatgcttcgtgataaagtgggaggcattggacaggtccgggatgatggacttgtgtgtcgtcttgtcaatccatttatcaaagatcaggatcagggacggcagaagcgttacacagcagacaacaccgatgaccacacctttggccatgacaataccgatgttcatgccgagggcaaaggtcataaaacaaagtgcggcaaaacctgcaatcgtcgtaacggaactgcccgcaactgacttaaaggtgttggaaaccgcatgagccatggctctttgcttatcattgtcaaaccgtaccttgttatcttcatagctgtggagcaggaagatggaataatccatcgtcacccccagctgaaggatcgccgtcagtgctttcgttatgtatgagatctccccgaggaagatgttgcttccaaggttatataagatcgcgatgccgatgcttgccagaaacagaaccggcgtcagcagggattccatcgtgaggcacagcacgagcagagacatcgccgcagcgattaccacatagattggcatctcttccagtgccaggtttttaatatccgtgacaattccggacatgccgctgataaaacactgtttgcctactacgtggcgcatctggctgaccgcttccatcgtttcgtcggatgacgtggtgttgtcaaacagggcgatcatcatcgtcgcattcttgttaaagaaaacattccggattttttccggcagcatttcctttggaaaagtggtgtctgccaggtcgtcgtaccagagaaccttttttacatggtctactttttcaattttgtgtttgatcttctggacgtcttttaccttggcgtcttccacgacgaccatggagaaagccccggttccaaattcatctaccatgatgtcctgacccttgactgtctccagtgaattggggagatagctcaggatgtcatagttgatcctggttttggaaatgccgatcagtgatgggatcaacagcagaacggaaagcagaacgatcaatttccgatgctttgcgatccattttccaaatttaatcataatcagtcctcctaaatgaatgaccaaaagtcatttttcttattaatggtatactatagaaatgactaaaagtcaataattatccagaataatctttcggtttttgaaaaatattgacttatagtcagtttaaagtataattatgttataagaaggcataagcaaaagggggatacaagccaatgagtaaagtagaagaaaataaaaagagaaagaaaacagcgcttcttgacacggcatatcacctttttacacaaaatggttatcagaagacatcgatctcggatatcgtgagtcaggcaggggtcgccaaggggacattttatctttattttaaggataagaccgatatccggtataagctgatcgcacaccgggccggactgatttttaaaaaggcttacagggatctggagagagcaaagatccggctgtttgaagacaagatcgtgtttttggcagataatattattgatcagctgtaccggaatcccacgctcctgaaactgatctccaaacatctgggatggggcatctttaaaaatgcgatcaatgaaccaatggacggagactatgaaaatatatatgaagcttatatgaatctgatgaaggaatccggaagggaatttgaggagccggaaacaatgatctacctgatcgtggaattgatttccggaagctgttacaatgcgattctgttcggacagcccgttacattggagcaattaaagccgtttttgtataaaacgatccgcagtattataaaaaatcatcaaaaatagtacgatgtacgttattttaagcaaacaaccacaggaaatcatgatataatgagggatacgaaaactgttaatcagatgatgaaaccctcatcagtagttataaggagtaatgaatgaaatcttgtggtattttgctgcctatcttcagcctgccgtcttcgtacggcatcgggtgcttttctaaagaagcctaccagtttgtagactttctgaaatcaacaggccagtcttactggcagatcctgcctttgggtacgatcggggaagggaattctccatatttatcctattcaagctttgcgggaagcgtcttatatattgacttaaagcagctccaggcagaaggcctcctgactcctgaggaatgtgacagctgggactttgccgacggcgaggacaaagtagactacgacagagtctttatgtccagggagatcctgctttggatcgcatacagccggttccggggaggaaaagactacgaagatttcaaacatgtccataaagagtggctggatgatttctgcagatatatggatttaaaacagccgggaaaagggagagagtatttttgctttgtccagtacaaatttttgagccagtggctgaagctgaaacagtacgccaatgcaaacggcatcagtatcattggcgacctgccgttctatgtggcaaaggaaggtgccgattttcaggcacatccgcaaatgtttcagctggacgaacagggagagccgagagtccagggaggatgcccgccggatgcctttgcagaaaacggccagctctggtcaaatcctgtctatgactgggactatcacagaagtacaggatttgactggtggctgaagcggttaagccacaatttcctattgtatgatgtgctgagactggaccatttccggggctttgacgaatactttgtcattccggcagatgccgagacagcagcaggcggcaactgggaaaaagggccgggcctagattttttcaagacattgaaagagaggcttggggatgtgaagatcattgcggaggatctcggttttctcacagattctgtgagagagctgcaaaaggagatcggctatccgggaatgaagatactggaatttgcctttggggcatgggatgacagtgcgtatctgccgcataaatatgaagaaaactgtgtggtttatacaggcacccatgacaacgatacggtccttgggtggtatggagacatgccggaggcagataagaatttcctgcatcactatttagaccacagcacgatcgtgcgcaccggagaggtgaacctggatctgatttctctggctcttgagagcaggggaaatacggtgatcattccgcttcaggattacctgggactcgggagccgggccagaatcaatacgccttccactgtgggggacaactgggaatggagagtcacaaaagaacagctgaacagtgaactgaggaaaacgatcctcacgctgcatgaccgataccggtcagaagaaactatcggaggaaactcataaggagcagaaacctatggcgaaagtatccaaaagagtaacaaaggaacgagtgagaaaaatctgtgatattctgaacgagacttatacgacagaatacaaatgttatttaaaccatgaaaatgcatggcagcttctgatcgcgacgatgctcagcgcacagtgtacagatgccagagtcaatatcgtaacagaaaagctgtttaaaaaatatacgagtttggaggcatttgcccgggcagatatcaaagaactggagagagatatttattccacaggattttataaaaataaagcaaaaaacatcatcggagccgcaggtcagatcatagagcggcacggaggagaagtgccggagagcattgaggaactgacggctctggacggagtgggaagaaagaccgccaatgtgatccggggaaatatctttcatgagccgagcatcgtggtggatacccatgtaaaaaggatctccaaaaaattatatctgacgaagaacgatgatccggtgaagattgagtatgatttgatgaaggtgctgccgaaagagcagtggattctctacaatatccagatcattacccacggaagaaacatctgtatcgccagacggccgaaatgcggagaatgtacccttaagagtgtctgcccgtcatgtgaggtatagcctatgaaagagtacgttgcctttgatttggaaaccacaggactttccgtggaggaagatcaggtgatcgagatcggtgcggtgaaggtcaaaaatggtaagattgccggaaaatacaactgcattatctatccggaacgggaagtgtcggattttattatccggctgacagggattaccaggaagatgctggacggcggaatccccatgcgcgaaggcgtggagggcttcctcgcattcagcgagggttatccggtgctgggacataatctgatgtttgactaccggttcatgaagactgcggcaaagagattccattatgcttttgaaaaagaaggggttgataccctcagggccgcccgactgctgcttcgcggtctggagagcaaaaagctttcgagcctctgtgagcattatcactatgtcaatcaggcggctcacagggcctatgacgatgcactggcaacagcagtcgtatttgagtccatgaagagagaattcggagaggaccagaaggtctttgttccggaaccgcttcagtaccgtcccaaaaaactccagatgatcacggcaaagcaaaaacggtacttgaatgaactgaggaaatatcataaaatagaggataacggcagcatagacggactgacaatgagtgaagcttccaagacaatagacgagattatttcaaaatatggggtgatgcgatgaaaaagaaaagaatgatcgccgggatcatagcaatccttttggtgattgtaatggtcggcacgacagtggccggttatttaatggtataataaggacaacaattttgcagacgcgaacattttaggaaggataggtatgtcaaaaagaatgaaagccggcattgctgccgggattttagccgtaatctgcattggtgtatttgtatatatcagtcagacggtaaaaggggctaccaaagataataaaatagtccggggggttatatttgaaggaaaatcccttggaggaatgacgaaagaagaagcaaaaaaagagattgaagattatatacagaaggaacaggcaaaagatattacattttatgtggacggcaagaaagcagtgacgaaactttcgaagacaggcgttacatgggatgtggaggaaacagtaaaagatgcctatgacgtgggacgttcgggaagcattataaaccgttattcccaggtaaagaaggacaggacagtcgtaaagaccgagcgcagatacgaccagaagacatttgacaaggaactggattctgccgcgaaaaagattctctcagagcctaaaaatgcatctttaaagagaaagaatggaaagtttgtcatcattaaagaaaagacagggtatgcgctggacaaaaagagtacgtttaaggcatacaaaaagcaggttgaggcggaaagcttcaaagtacctctgaaagtcacaagaaaaaaggcggagtataccagcgaagacatggcgaaagtcaaagataagctggggacaaagacgacctattacggatcttcggcaccgggaagaaaaggaaacgttgccaacggcgcaaagatgatcaatggaacggtcgtgtatccgggagagactttttccgtgtacaaagcggtttctccgtttacgagtgagaatggttattatctggcaggctcttatgagaacggtcagacagtccagacttatggaggagggatctgccaggtatctacgacactttacaatgcggtgatccgggcagagttaaagatcaaagaacgccatcctcactctatgacggtatcctatgtgccgagatctgccgatgcagccatcgcgggaacctataaggatttgaagtttgagaaccagtatgatttccctgtatatatagaaggaattgccgatggttctaatatcactttcagcgtctacggacagaaaaccaatccggaccgacacgtggagtttgtctctgagacgacttctgtgagaaacagttccggggagaaagtgatcaaggacccgacactggaagagggtaaacggatcgtagaacaggtcggacacaccggctacactgccaagctttggaagatcgtcaaggaaaagggcaagaagacacagaagattctgtttaatacgtccagctatatggcgactccgaacacggtgagagtaggaaccaaaaagaaggataaggacaaagacaagaagaaaaaagacgcggataagaaaaagaaagacagcaaatcgactgaaaaatcaacggagaaatctacagcaaagaaaaagactcctgcgaagaaatcaacagagaagaagagtactcaggcaactcaaacatccaaagagaattgatcaggggaaaatcatgaagataggaaaaattccggaagccacattaaaaaaagttatattagaacagctgggaacgaagcgggacgaagtcctgatcggtcccggcattggagaagactgtgcggcattgaagcttgaagaaggagaggtattcgtactctccactgacccgatcacaggagcggccaaagaagcgggcaggctggcagtgcatatcaccgccaatgacctgatttcttcgggagccgaaccggtgggactcatgctcacagtcctgctccctccggagacgaaggaaaaagaactcaggcagctgtcggccgaggtacaggaagagtgcgtaaagcttggcattgcagtgatcggggggcacacagaggtgaccgatgcggtcaggcagccccttatttctgtcaccggagtcggcaaggtgaaagaggaagaacttgtgtccaccagtggcgccgcgccggggcaggatatcgtggtgaccaaatacatcggcctggaaggaaccggtatcatagccagggaacgggaggaactgttaaaagaacgttttccggaagagttccttgacgaggcgaaggcctgtcttgaacaggttacggttgtccctgaggggaagattgcgcggaagtatgcctcctctatgcacgatattacagagggcggaatttacggtgctctctgggaagtggcccaggcctcgggcgtgggactggaagtttctatcgaggatattccggtcaggcagcatacgatcgagctgtgtgagttttttgatctgaacccgtaccagctgatctccagcggttccatgctgatcgttacggatcacgggaatgctcttgtgagagaactggaacaggaaggaatcaaggcctcggtgatcggccgtaccacagattctaatgataagatcatttacagacagggtaaggcggcaagcctggaagctccgaaacaagacgaattgtataagataggagagagatcatggatcaagagctgagagaatcaatattaaaattaatagaaaagaacagccgtctggacttaaaagagctggcggttcttcttgattctacggaagtagacatagccaatgaaattgccgagatggaaaaggaacacatcatctgcggttatcacacgctgatcaactgggaccacacgagccgggaacagctgactgccatgatcgaggtaaaagtgacacctcagaggggagaaggctttgacaagatcgcagagcgaatctacaatttcccggaagtaaaagcgctgtatctgatgtcgggggcctatgatttcatggtcatgctggaaggaaagacaatgaaggagatctctatgtttacttcatcaaagctggctcctctggaggcggtattaagtacggccactcactttgtccttaaaaaatataaggaccacggaacggtgctggaggcaaaaaaagcagataaaagacaggcggtgactccataatgaaagatatgctgtctaaaaaggccgtgatgctggaaccctccggcatccggaaattttttgatattgtgagcgagatgccggaagcgatttcactgggtgttggagagccggattttgacactccgtggcggatcagggaagaaggtatttattctcttgagaagggcaggacattttatacatccaatgccggacttgttgaactcagagatgagatctgcagatatttaaaaagaaaatatcacatgcgctaccgcaatgacgaagtgattgtttcagtgggcggaagcgaagggatcgatgtggctctgagggcaattttaaacccgggtgatgaggtgattgtgcctcagccatcatttgtctgctatgtgccgtgtgtcattatgtccgacgggatcccggtcactgtggagcttaaagaggaagataagttcaagctgacgagaaaacagcttgaggaggtggtgacagataagacaaaagccattatcatgtcgtttccgaataatcctacaggcgctattatgacgaaaagagatctggagcctatcgccgattttgcgaaagaacatgatctgctggtgatttccgatgagatctattccgagcttacatacgggcacaggcatgtcagcatcggtgcgcttccggatatgaaggaaaggaccatcgtcatcaacggtttctccaaagcatttgccatgaccggatggaggctgggctatgctgcagctccgaaagtcatcatggagcagatggtgaagattcatcagtacggtatcatggcggcgccgactacgagccagtacgcagcggtggaggcactccgagcctgtgatgatgaggtggaggagatgaaaaattcctataaccagaggagacgctatctgcttcaccgattccgggaactgggactcgattgttttgagccggaaggggcattctatgcatttccgtgcatcaaggaatttggcatgagctcggagaagtttgcggaagaacttttgaaagaacagaaggttgccatcgtcccgggaacagctttcggcgcctgcggagaaggatatttgagagtatcctatgcgtattccatcgacgagctgaaagaagccctgaacaggcttggcacatttattgagaaactaaggagataatcatgctgcatattgttctgcatgagccggagatgccggccaataccggaaatatcggaaggacatgcgttgcctgcggcgcggtcctgcatctgatcgaaccgctgggatttaaactgaatgaaaagatgatcaaaagggcagggctggactactgggagcacctggatgtgaggacctatgtgaattttgaagattttcttgagagaaatcattatcctaaaatttatatggcaactacgaaatccaggcagacctatgcagatgttacttatggggaggcggatgaagacgtctatctgatgttcggcaaggagagcgccggtatacccgaagaaatcctgctggactacaaggagactgcagtcaggattccaatgcttcctgaaatccgttctctgaatttgtccaactctgtggcaatcgttgcctatgaggtgctgagacagcagggattcggtcatttccagagagaaggacagctgcaccgctacgagtggtaggaaagaatgaaattcagggatatttgggaattagcgaagacaagggcgaaagacagcctctacactttggttataattgaagtcattattataatgatcgtcatgggtcttcaaacatggaaaataggcttagtaatgttgttcccttttctggcgcctgcattgctgatacaaatttcaaaacagctgctgatgttcattttttggacaggaaatatttttgcctgtatgatgacagcgatgggtgtggaagcgaacgtagaatatatcttttatgtatttcagaataagtcaaaaggaatcttatggctgcttctgagaaaagttttaatgatgcatggtaattacttgagattaatcacgttttggctgttttttatcccgcggctgtttatcggtctgctgttcctgggagtgggcgttctggtggtcgctccatgggttcaggtttctctggccactttttatatggaattaaagcagcaggaaaagataagaatacgcagtaagacggaagatgacatcagacagggcagtacatgagaaataaaaagatattttaaataaattaggagataagaaggagatcaatcacatggcaaaagaaaagaagctggtagaagccatcactgcaatggatgaagactttgcacagtggtataccgacgttgttaaaaaggcagaattaattgaatattccagtgtaaaaggatgcatgatccttcgccccaacggatatgccatttgggaaaatattcagaaagtaatggatgctaaatttaaagagacaggtgtggaaaatgtggcaatgccgatgtttattccggaaagccttttggagagagaaaaggaccacgtggaaggctttgcgccggaagttgcgtgggtgactcacggagggaataagaagctcgaggagcgtctctgtgtaaggccgacttctgaaactctgttctgtgatttttactctaatatcatccagtcttacagggaccttccgaaattatataatcagtgggtgtccgtagtacgctgggaaaagagcacgagaccgttcctgcgcacctctgaattttactggcaggaaggacacacggcccatgcgacggcggacgaggctgaggagcgcacagtccaaatgctaaatatgtacgcagatttctgtgaaaaatatctggcaattccggttgtcaaaggacagaagacggagaaagaaaagttcgcaggagccaatgcgacttatacgatcgaagcactgatgcatgacggaaaggctcttcagtcagggacaagccataacttcggagacggatttgccaaggcattcgacatccagtataccgataagaacaacaaactccagtatgtccatcagacatcatgggggatgtccacgcgtatcatcggggctattattatggtccatggtgatgattcagggcttgtactgcctccgaaaatcgcgccggttcagacgatgatcgtgccgatcatgcagaagaaggaaggagttcttgaaaaagcagaagagatcagagaacgtctttctaaaaactataaagtaaaagtagacgattccgacaagagtccgggatggaagttcagtgaacaggaagttcagggaatcccgaccaggattgagatcggaccgaaagatatcgaaaagaaccaggcagtgattgtgcgtcgcgatacgagagaaaaagtctttgtttcccttgacgagatcgaaacaaagctttcagaggtgcttgaccagatgcagaaagacatgctggaacgggctaaaaagcatttagaggagaatactcacgaggcaggaaactggaatgagtttacggagatcattgaaaagcagcagggctttgttaaagcaatgtggtgcggggaaaccgagtgtgaagaagccatcaaggacgagacaggagctacaaccagatgtatgccatttgtacaggaacatctcggggacgtgtgtgtgcactgcggaaaaccggctaagaagatggttcttttcggaaaagcatattgaaggaattttatgtttaagattgtgatacctgaaaaagcaaaacagatcataaatcagctggaacaggccggctacgaagcatatgtcgtaggcggcccggtccgggactgcattttggggaaatgtcctacggactgggacattaccacatccgcatctccttaccaagtaaaggagattttttcatatacgatcgatacgggaattgctcacggtacggtgacagtcatgatgggaaaagaaccatttgaagtgaccacttaccgggtggatggagaatacaaagaccacagaaggccggaggaagtctgttttactaaatccctgaaagaagatctgctgagaagagatttcaccatcaatgccatggcatacaatgacagggacggactgatcgattattacggcggagcggaggatctcaaaaagaagaccatccgctgtgtgggggatgcccgcagacgttttgatgaggatgcgctcaggattttgagagcactgcgttttcaggcacagcttggatttgtgatagaagaagagacaaagcaggccatacaaaagcaggcgaagttcttaaaagatatcagtgcagagaggattcagacggagctcacaaagcttctcctgtccgatcacccggaaacgatccttgacgcatatgatctgggagttacaaaagtggtgctcccggaatttgaccggatgatggagacacctcagaacaacccccatcactgctataacgtaggagttcatacggtggaggctttaaaaaatactgagcctgaccatattctgcggtggactatgctgctccacgatgtgggaaagcctgaagccagagtcgagggaaaggtaaaagacagctttcaggggcataatatcatcggagaagagatgtccaggaagattttgagaaggctgaaatttgacaaccaaacgataaagcaggtgaccagacttgtatactggcatgatgtacggttcgcttctttgggtgaagtcaataaaaagactgtgagacgctgggccagcaggatttctgtgccgctgtttgaaaagcttgtaaaaatccagcaggcagatatatcagcccagagcacttttatgcaggaagaaaagcagcggatccttgacagtacgagactgctgtttgaggaaatcaaagaggaaaaggactgtcttcaggtgaaggatctggcccttgacggaaaggatctgatcagtctgggaatgaaacccggcaaagaaataggagaaatgctgacaggactcttagaacttgtgctggaagatccggcccaaaataaaagagaagtattggagcaggctgtcagggagaaaagaggagagctatgatcatacttgtgattccgttttgtatttttctttacctgtatatgatctatccggggaagccgagaaagcatccggtgctggaaacaaaatgctttgcacaccggggactccacggttttgacgggataccggaaaactccatggcggctttcaggaatgcggtcatttacggatacgggattgaactggatgtacagcttaccaaagatgatgtgatggtggtccatcatgattacgatttgaaaagaacctgcggcgtcaataaaaagatccgtgatctgacttatcgggagcttaagagatattctctgatggagacaaaagaacggattccacggtttgcggatgtgctggctttggtagacggaaaggtgccgctcctggtggaactgaaaatggagcactgcgaccggaaactctgccggctggcggcggaagcactggatcagtaccggggactttactgtatggagtcctttcatccgtttgcactgttctggttcagactaaaccgtccggaagtcatacgcgggcagctgtccatgaatttcagaaaagatcgtcatagggggaatcagcttgccttctgggcagagcagaatcttttgacgaattttgcggccaaaccggattttattgcatacaaatatatttactgggaggagccgtccctgaggctgtgtcggaagatttccggtattccggtctatggatggactttccgaagcagagaggaatatgaaaagtaccgcagaaagttttatggatttatttttgaaaagtttatgatataatgtacgcggagcgtgaatatgataacattgcgcactcggaaggagatgtaagtcagatatgaagaaaaatatcgctgtgatcttcgggggaagatcctccgaacatgaagtatcctgtgtttcggctgccacagtcatacgaagcctggatgaagaaaagtataatgtgattttagtggggataacaaaagacggccgctggctgcttgtggataaattaaaagatattgaggacggaagctggagagaatccagggtgaatgcgatcatctctccggatacggaagacagggcattggtactcctcgcagagggtacataccggctgcagcctgtggatgtaattttcccggtgcttcacggtttaaacggagaggacggaacgatccagggactgtttgagatggcccggattccctatgtgggatgcggagtattggcttctgcagtatcgatggataaggtttatacaaagattatcgtggaggatcttggaatccggcaggcccggtttgtccatatccgcaggagcgatctggaccagatggaggatgctcttgacagggcggaggcaaagctttcttatccgatgtttgtgaaaccttcccgtgcagggtcttccgtgggagtttccaaggctgaggacagggaagggctttcaaaggcactgttaaaggccgctgaacatgaccgcaatattttagtggaagagactatcgtgggaagggaagtggaatgtgcagtcctcggaggaaaagagataaaggcttccggtgtgggagaaattctggccgctgccgatttctatgattatgatgctaaatataacaacgaagaatcaaagaccctgatcgatcctccgatgtcggaagaaacgagagaggagatccggaaatccgcagctgatatttttaaggcggtggacggatacgggctttcccgtgtggacttctttattgcagaggacggggaagtagtatttaatgaaatcaatacccttccaggctttacgtccatcagcatgtatccgatgctctgggcggcacagggaatcacaactccggcccttgcagacgaactgatccgtcttgcggaagaaaggtttgaataaaaatgagcaatgtacatgacaatgcacccatcggagtgtttgactcaggggtcggggggcttaccgtagcccgggagatcatgagacagctccccgatgagagcctgatctatttcggcgatacggccagggtgccctatggtacgaagtcgaaagatacggtcatccgttattccaggcagatcgtgaatttcttgctgagcaaaaatgtaaaggctatcgtgatagcctgcaatacggccagcgcccttgccatgcacaagctccagcaggaatatatcgttcccatgatcggcatggtgcgtccgggggccgttgcggctgccagggccacgaagaatcaccatatcggcatcattgggaccaatgccactgtaaagagcggccaatatgggaagtatttaagggaactgaatccggatgtaacagtggtgacaaaagcctgtcctctgttcgtgcctctcgtggaagagggactgatcgacgacaggatcacagaagatatggtatccagatatttgagggagtttgaccagtatcagatcgattccctgatccttggatgtactcactatcctctgcttcaaaatcctatcaaaaattttgtgggcgacgatgtgactttgattaatcctgcctacgagacggcaaaatccctgaaggaactgctgagagaaagggagatggaagcggaaagcggccatacagctgagtatcattattatgtcagcgatatggaagaccagtttttgagttttgcggaccgggttctgccctgtcatgtggaaaaagtacaccctatagatattgaaaggtattagaggagacaaatgaacaaagaagtgattatcaatatttccggtcttcagctggatgccggcacggaagaacccatcgaattgatgacgacaggggattattatctgaaaaatggaaagcactatgtcatatatgatgagctgaccgatgattcccaggtcgtaaaaaaccgtctcaagatcagcccgaaaatcgtggaagtaacaaaaaagggagccagcagctcccatatggtatttgagcggggaaaagaaaacctcacttattatgacactcctttcggaagtcttctgcttgggattaacacaagcaagatcgactttgaggagaaagaggacagtatggcgctgcacatcgactacggactgtccatcaactcagatcatgtttcagactgctccatcgacgtgtccattgcgtccaaacagccggaaaacagagactgcacagacagtgcccagtaggattccgccgaggacatcggttggaaaatgtacatacagatagagcctgctgaacgcgatcagtgctgccaggacaaaagctgggattcccagctttttgttgtataaaaacaagtatacggcggcacagaaagaagaagccgtgtgaccggacgggaaagaatactggcccggaggcgggatcagcagttcgatatcccggtgagtaaaaggtctcgcccggcctgcgagaggtttgatgatatgatctcccagtatgtaagtgaccagcatggcaatgagcatgccgacacccgcttttctgtatttttttgtgaacaaaaggataaccgcgatcagaatccatatcgtgcccgcgtcgcctaaatgtgtgatcctggagaagaaatcatccaggaacggggctcttaaatgtgtttgtataaagttgagtatttcaaaatccataaagtctcctcacttttttactaaattatatcacaaaacccggcttcgtgttataatatcaaaatgaattacaacagatagaaggaatgaagatgattacactagttgcaaataacatcggagtggatacctacctttggctccgggaagctgtaggctttaaaaagctctcaagaactcaggccgtgaaggcgctgaaaaacagtctttatgtggtggcggcctatgcggatgacaggatcgtcggcatgggaaggatcgtaggggacggagcggtcatctgctatattcaggatctcatgatacacccggactaccaaaaggccggagtggggagcaaactgattgagaatctggttgctttcgtggagagtatcagggaggataatacggagatgatgctggatctgatgtgtgcaaagggaagagaagccttttatgaggcccatggttttatttccagacccaacgagagtctgggacccggcatgataagatacctaaatgaaaggagagcataaaatatatggaagagaagagatatgacccttatacgggagaagagatcaaacagccggcggaggaagagtgcattcaggaagagactgaggccgggagtgcagccgaagcggagcagaaccagaatcagactgcttcatccgatacgattgtagtcggtgagagcggatactattatcaggagaaccggcaggctgattaccgatatcagggaggccagaccggcggacccgcatatcagagtcaggaagagccgcctcaaaacaactatgcaacggtctctcttgtacttggagtcttggcgatagccctggcctgctgctgtttcccggtgtcatttgtcctcggcatcgttgcgatcgtattattttgtatttccccgaaatacatgggaaagaaggacggcaaggctgtggcaggtctgatctgcggcatctgtgggctggtcctctccatcatgatcactgtctttgtggctgtaaatcttgcaagcgacgattacgaaagctacatcaacaagtatgatacccatgacaccaattctgacgatgatgatatctgggatgatacggacgatgtagatacaagcgacaactgggacgaagaaatctaaatgatgcagaagatctggagattcatcccaacattcccatgcatatttaaactggccaccaacctttactgccccgcctgcggagggaccagggcagcactggcttttttaagacttgattttttgacatcgctgaaatgcaatccaacgtttacctatcttgtcttaattgcagggtggcttgccgtcggggcagcggtcaggaaaaccggaaagggaaccggagagatttttcggttccgtatgtggatgctgtatgtgggactggcgatattttttggatttggaatactcagagatatcggactgtatttttatcattatgattatttgggagatttttattaattaaacttgtggtatatagaaagcagtgcggatacgaaaaagattccggcactgctttttttatttgtttatgaatgatgtatacttagaaaatagacaagagacggcaaaatcatcaattttatattctaaaagacaaaaatgaagtggtcaagttaaaatttccagaaagtttaattatgaaataaaacttagaagttttatctaaattacagaaatataaaaaattgaatataaattatatatgtctttttccttatcttttcaaatcttctcaaatgtccgaatagccccattttatcagctgttcgggcattttgcttttgtggtaaacctcacatatctaggtctatcttcttatattttccctgtcaatcgtggttaaaatcgtggtaaatacttcttatgcaattagacgctgaacctctgattttgcggtatctatggacgcatgagcataccagttcatagtgatactgatatttgaatgccccatgatatactgtaaatcctttgggttcatgttcttgcttgccaaccttgtgcagaacgtatggcgtagtgtatgcggtgtgatatgtggcaaggggttatccttatggtgcttgttgtatttctttaccatacggataaatagcgttgtgtaatcaatcgccacctttggcttgcctttggaattgacaaataggaagttgctccgtccgtctatcacaaatggttctgcctttgggcgtttcttaatcactctgtgaaatgcttgtatcgtttctttgcttaatggcactttccttgttccgctctttgtcttaggcgtttcaatgtaatagccctgttccttgctttttaataactggtggtcgataaccacaacctcatggataaaatcaacgtccatgactgtcagtccacacaattccgagatacgaagtccagtctttaacagtatcagcacatcatcataatacttgtgatacacattgtctgtcttgatgaatgacagtaaggcttgttcctgttcctctgtcaatgcgactttctcttttgtatcgttttctatgacttcacttaacttgaaatcaaagggatttttcctcacgcaatcgtcttgtatggcaatatagaatgacgcttttaacgagcgtttatggttgttaatggtattgtaggaaaagcctttgtctttcatgcgtaacgcccattccttagcgtcagagggtttgattgtgtcaatgctcctagcacctaacttgtcctctttcaataaccgcatgagctgttcccgttgtttctgtgtgcttttcttcacgtttgccctttgtgcattctgtttggcgtagagctggcaaagggtcattttcttgcctgtgctgtcgataccgtcctctatatcccgtcttatctgctgttccagttcccgaagtgagggcttttcccgttttccctttggtgtcgggtctgtgggtgtcaatctccaagcatacacatattttgtgtttccaaatgcgtctacatatttatataagtattttccgtctgttcgttggctctctccagtatgcaggatacgtcctttgttatcccgtcttatttctttcatggtgtctgctcctttccttgttggaaagagccttgatatgacttgttttcatcataacacatacaaggcttatttgcattagattgcgtccaatttatcaatgacctgttcaaactgtcggcgtttaatctgtatgcggttaccattcataatgagccagccagcgtccttgttttcctctgccaatcgtcttaacttgttttctccgatacgaaaatattttgacgcttcttcaatggtaagggtgtatttttcccatacgggaatgtcctgtgcattactcataaaacaccccctcactttcaatgggtagtgtcaagttttactacctgtcttattgttttaaccttgattttatgggagtttgcaataaaaagagcaatgacctccctttttgaagtataatgtagttaccacaaccaaacataatacgaaaggagttcattgctcatggacattatactttatttacttcaacttattcaataccaacataaacaactttgctggcttattaactttatctgtagatacatcccacttaagcagtgggctttcgatgattcccattctccgaaatatcaaaaatttaaaattgatcagctccccaaattcatttcctataaacaggaatggaactggaaggatctcatctcttactatcagcggcgttaccataaatccattaagcctgtgttcagacgcgtggaatgtgatatccccaaatcctgtcactgtcctgtttgcggtgcgccggttgactatctcacgtggaacgatgggaaacgaaaatcccaagtgctgtgcaaggtctgccagacacatttttctccaaccaaagataaccgtttttccaaaactaccgtgttaaagtgtcctcactgcaaccgcaatcttgaacacaagaaagaccgtaaacactttattattcataaatgcgtaaatcctaagtgtccttactatctgcacaacctgaaaaaagttgataaaaagcatctgaatgaggattacggtaaaaataaatataagcttcactacatctaccgtgaattcacgatagatttctttcggatggatttaaactctctcccaaagaatgcctcttctctcaaattcaccaagtttgattcccacaccatgtctctatgtctgactatgcatgtgaatcttggactttctctcaggaaaactaagcaggcgctccatgacctttacggtatcactatctctcatcagagcattgccaactactgtaaatccgcagctctttgcatcaaaccctttgtcgatcattacgattatggcaccgaatccgtcttcacggctgatgaaacctatatcaaaatccgtggtcttaaagcttacgtctggttcattatggatgctgcaaaacgttccatcattggataccggatctctgataatcgcggtgttggtccctgtatccttgcgatgagaatggctttccgaaatctaaaagagcttccgaaaaactttaaatttattgcggatggatacagtgcctatccattagctgcccagcagttcttccatgagtttggtgataaatttaagttcagcatcactcaggtaattggacttaccaacgacgatgaagtgtcaaaagaattccgaccatacaagcagatgattgaaaggctcaatcgtacatacaaggtctcttacagacctacgaacggctttgacaacatcgacggcgccaactatgaccttgctctatgggttgcttactacaatttccttcgtcctcacaaacacacaggatataaagtcctaaatgaggtggaactgctaaaaggagccgaaaacatgcccggcaagtggcagcttcttatattccttggtcaacagacgatcctgaatcttcaaaaccggaccacagcctaaaaggagcggaaccgttgtcacgcaaaccgtggaataccacagtgcaccgcacaaggatatgccgcgaaagttgcttgacataagggttctcggattatcctgtttagcagaaaaggggcaactgcgcccttttcctgccttccggcgaggatgggttcgggcaaagcctgatattaggtcaagggacaagtcccttgcgggtacttagggcagcgccctaagccctcggagagcttaacgttatcaatatctacaggtttcaaggttcatctgagcctattttttatgctcagctttttcatacatcacttgacactatctttcaatgacctctgctatatccgtacacatctgttccacaatcatttcctgcttttcggtaaggcttgttacttcatcaatcattttcatgtagtttgagcctgtcagcctgtcgatttcctctatcatcacaatggacggcatgacctgtttttccagccatagcagagtacgttccatattgacgggtacagggttcatttcaaaaggtaaactgtcatgggaaatgaatatctcccacaacggatagtcgggaaagtccacaaaatcagtaatgaggtaaaacaccagcccatgagggttataggtcaataacagttcctcaactgcctgtaccgcctttgtatcacgcagacggatttcaaaacggttgataatatccgtatgtttccttttcgttgcctgttccttttgtttttcatacaggcagaaatatttcattcctgtttttgaaccgatatagagtgtatctgctaaattgcggttttttccgcccagcctgccactatggacactttcaaaactttttgagcgacattccgtatttcccctgtggtatttttcagacaggacaggaatatccagcagaccgcacatatcattgaccgctaaatcaatacgcttgatgataccgcccaaatcaagacagcggtttaagaatgaataccagtccctatgctgtgcctgtaagacgtactccatattgcgtgagccagttcctttcaattccacaaatacgcccatgtgtttatcatcagataccatgaccttgatttctccataggcataatgttccttatatccataatacccgtagtcaaaatggataaagtatcttgctttcattcccagcaattttctgatgatagccagtccgtccgtggtcgggaaacggacagcgagatagtcaatccataaagtaaatggcttttcgcagatacagtaattcaaagaacgcagtataatattctgtgtttccttgctggcgttggcttttccgttctcaaagcgattgatactatatcttgatacaggggtaagacctgccagctctccttgtgaaagaccgctagcaagacgcttgtttttcatttcaagtgcaaattctaagttgttcattgttttcctccaatcccacaatagccttgaaatacctgtaaaccaactttcaaaaggtgtgatatgcactatcttcttaaaactcctcattactccttacagctttggggttgtatggtttttgacttgtcttttgtgtaatagtgcccccctgttagagaacgggggcacagacaaggctcgcaggctcgccagccgacaaagcatttccgccctttgacggcaagccgtcatggcgttgttgctgacgcacgccaacagtcctacaatgctttgtcagccaattctatttttaccttttctaacaagctccatttcaaccgatattcatatctacgggtttaatcagataggttctactttttgaatattcttatatttcattctattgtgcttattcaattacaagaacatagtaattcttatatgcttatttgtcaatatatttttttgcctttacaaactatattaagcgtgatagacttataacagtgaagatataacgagatatggagggttatgcgatgaaaataagccatttaggaaataatatacagaccataagaaaattcagagtaatgaaacaacaggagcttgcggacaaaatcggtatcaatatgcagagcctttccaagattgaaagagggttgaattatcctgcttatgatacgctggaaaagataatggaagtgctggacgtaacaccgaacgaattgctatcgggggaatggaaatatgtcaatcaagcagaaaaggaagtctgccagtttctaagaacggaagaacgtttaaatgcagaactgaaacatggacattatgataacttttttgacagcgaagaagaatggctggaatatgaattagaacagctacgtaaatatattacagattacatcaacggaaagaatatcaaggcaggcgacctttatccaatcaaagaagttatccagcatttgaaattccaaaaactgttagaccgctatgatgatttatacagcatggatatgttcggggaaagcacagagggacataaatataaaacaccttatcaagtcgtaaaaatgataaacccgaaatcaaaagaagatatggaactgttacgggaagtattaaggaataaccattttgaagatgaggacgagtagcctttttcctcttgtgaaaagatacagcaaacaaaaagcccgatcaagagtgcaaagcaccaccaatggtggcaagctcttgacagggctttttcttttctgtggtggttaatcaagaggaagaaagggataaaatctgatttataataaatcagacaacgcagctagctcgtttgagcttgtgctacataaggatagtaactggaagattgtaggttaaactcttaaagcgtgtagttctaattaagaatttacacgctttaaataataaaaatctttcacataatgtaagaaatatgttataatcgacgatagaatatttcaataaaggtggtgtgcaagtggctaaaaaagataaatacaaatttgatagtaagattcatattttccgtgctacaaagagaatgagccaacaagaacttgctgaccttgtaggagtatcacgtcaaacaattatacagttagaacgtaacagatataacccgtctatgttgctggcatatagcattgctaaagtttttaatgttgcgatagaagacttgtttgactttgaggagggaaattagtatgtatgatattttttataacttcatatctagtaagactattttaattctaggagcttggttgggacttccattatttattattttaattatcatgttttcaaaaaagaaaaaccgagacgagagaggctggaaaatttttgggaaagctagcattattacgtttatttggcttatgattataactaatgttattgcaaaaattgtcggaaacacgtatcctacttatgcattgcactatattgaatatgctaatacaatacaatggatttttaattcttctataattgtagagcttatttcagttatcactttaagaaaaatagagtaaattatttcaaattattcatcagaaatgatggatattttttctttcttatagtaagaaatactttacatttagagataaatagattattattataatagttttaaattatttgaaaggagttaatcattatggtaacatttgcaatcgagggaattattattgtatcggctcttatttccgcagggagtatgataagacgaaaaccagctaaatcaaaaaaggttttagcaacaacaatcgtattgattattgcagtatttattggttttagtatggcacagttatgtagtattttaaatatagtagatttcgccataacttatacaccattggaaattttatcaatattatgttttgtttattggatttccttttttacttccaacagttccatgtttgataaaattattggagaataatcatcatagatgtttccaaaacctaaaacggtcaggcataggtctggctgttttttaatatcttgtaataaacaaatgattggtgtgataatgtgaaaatttaaacgatgttttaacaatcgctcctacactagaagaatatatttacaagattacaaaaaagacaaagatttaatacaaatcaagtgctgtaagggggcttgctgtatgaaacgctttaagcacaattcaatccagatttaaaagcatactatctgtaattaaatacgctataacagtagctcgtacaaaattcatattttgtgcgggcttttttactctcttttctgtgttttccaaaggtatagacggcatttccgtttatatatttcagattatgcggaaaaaggggggtgaaactatggacacatcttcttttgagcatatcgttagaatacagtttaatgctttgatgatgactgttattaaatgcacagtaaaaagtaggaataggaagtttgcaagacgttctcagcgtgaagttttattctgtgaattatcagatataaaacatcttgagtgtggaacaacggataactattcatgtgattatacttcttttaaagtcttgaattatacaatccgaatatcagatgagaaactagctgttgctttacatcagttatcaaagaaacagcgtgatgtaattttattacgctattttcaaggcatgagcgaccgagaaattgcagggctatatcatgcatcacattctgctgtttattacagaagaaataacggattgaagaaacttaaaacactattgaaagaaaggcattaaaacaatgagaaaaaaatatggctatcccacactagaagtaatatgcaaagcgtcctctggaaatgaaatcgctataaaggaaattctgaaattctatgacgcatatatctgtaaattgtgcttgcgtccattttaccacgctgaaagtggtaaaatcattatgcaggttgacgaagaattaaaaggtcaaattcatacagaaatgatgaaagcaatcttgaaatttgaaatcagagtgaagtaatcttacatgaatgaaaaatgggagatacacagatattttgtgctatctcctgtataattttagtgtcatatcaagactcgttcaatcgtggtaaattcgtggtaaaataggtgttttgctatacttcaaaatgcttgaaagtatagtatttatgcggataatcaaaaattagatataaaatttagattaaatagaaaatatatttacaactacatatatagatgataatattcagatatattaggaggaggataaatatggatagaaaaagcttagggaatcatatatgttggagtttcgtatttattatattttgttatgcatttggtagattatattcatttattgcagatggattcttaatagaaaggaaactacaatatattacaattgcaatgatttctaaaccggttatgtatcttatattagggttaatgtttgggattttgttatatttggagatattaaaacccgtttcaaaaaagcaaatggtgattgaaatgtttattgtagaaattccaattttaacaactgtattaaacgaatttgtaagagatatgttggtgaattatggatttcaggttgggcgtgttttagataaaccgtttcgttctgcaaggttaattgctgtaacatatgtttttttattattcattgtaagaagaaaactgttgtcccgaaaggaggaattatgagattgaggaaaaagtgttggtgtgtagtgatgttaagtgttggaatgttattcccaacaattgtatatggcaatgataattgcttaattaaagataatattgagacgtcataaatagcctcagttgaaagaattgagaatgataggttttcaagtgaagtaaattcaatacaaaaagtgatttctgataaactgaaagatcttagtcaatttgcagacattcaaattacggagtatgaagacaatagagttgagtattcttttattcccaaaagacctgaaagaatagagacttacaataatggggagcagttaagcgagtatgaaatggtgaagttgacagcagtacccagcaatcaaaatgcagagattgatttaaatagtgccaaaaaagcttcttatagttttcaggaaggcgatgatgtacaagaaactattacaaagaagcattcggatgtcagattaagaggaacatataattatacagaaggtatagctaaagaaccaggagctagagttaaagttgcgtagtactcatatctccttgtttatactaaataaatatcccgaattttcaaaatgtttcataaagcagatattaaataaataaaattccaatttcctattgactttatatgaaatgctttttataatacaacaaaacaattcatagcaatcatataggaaaaggagacaaaaccatgtatcagaagaaatccagagaggaaagaaatttaaaatttgaaacactgcagctgcatgttgggcaggagaaggctgatccggccactgatgccagggcggttcccatttaccagacgtcctcttatgtgttccacaacagcgaacatgcggcggcccggtttaacctgagtgatgcgggaaacatttacggcagactgaccaatccaacccaggatgtatttgaacagcgtgtagcagccctggaaggaggaacggcggcacttgctaccgcatccggcgcagcagctattacatatactatccagaaccttgcacaaaatggagatcatattgttgcggcaaaaaatatttatggcggaagctataatcttttggcccacacgctgccggaattcggagtggaaacaacctttgtggacatttttaaggacggagccgtggaagccgccgtcaaagaaaatacaaaggcagtctttattgaaacattgggcaatccccattcagatgtggcggatattgagaagatggcagagattgcacacagacatcggatcccacttgtgattgacaatacattcgggactccttatctgatccggcctatcgagtacggagctgacatcgttatacattcggcaaccaagttcatcggaggacatgggactgccatcggaggagtcattgtagacagcggtaattttgactgggaggcatccgggaaattcccttccctaacagaaccaaattcaagctatcacggcatcagctttacgaaagcagcgggcagagccgcatttgtcacaaagatccgtgctattctgcttagagatatgggggcagcactgtctccgtttcatgcatttttgtttctccagggattggagaccttgtctttgagggtggagcggcatgtggaaaacgcgctgaaaacagtggaatttttgagcaggcatccccaggtagaagcagtgcatcacccatctgtcacacaggacagagaacaaaagagattatatgaaaaatattttccaaacggaggaggttcaatctttacatttgagatcaagggggatgacaggacggcgaaagagtttatcgacaatctggagatcttttccctgctggccaatgtggccgatgtgaaatccctggtgatccatccggcgtccacaacccactcacagctgaatgaggaagaattgaaagaacagggattaaagcccaatactatccgcctttccatcggaacggagaatatagacgatatccttgaagatttgagtgaagcttttaaggcagttcaaaaatagaaaaatctgcagaaaacgatgtctgctcaggctttataaagccctgcaggcatcgctttttctgtatagacagagaaaatcgaacatgataaaattgctttaatgtattacaggaataaaggagaagcagatgaagatatcagaattactaaaagaaaaggctaccatttcatttgaagtattcccgcccaagagcaaagaaggggatatttcttccatctattataccattgaggaactggcaaaacttgacccggattttatcagtgttacatacggagccggtgggtcttccaagggaaagaccgtggagatcgcatcggtcattaaaaataagtatcagatcgagtccgtagcccacctaagctgcatcacatccacaaaagaagatattctcacggaatgcagggcattaaaggagcacaatgtcgataatatcctgtcactgaggggagactatcctgtgggagaagaagaaaaataccggggaatggatctggagtttcactatgccagcgaactgaacggatttatcagggagaatttcggggaatctttctgcctttccggggcatgttatccggaggtccatcaggaagcggactgtttccgggatgatctggaggcactgaaaaaaaaggtggatgcaggagcagaatacctgattacccagattttctttgacaacagctattattaccggctggtgaaagaagcgagaaaaataggaatcactgttccgatccttgcagggatcatgccggtgacgaatgcaaaatctcttttgcgcacggccaaactgtgcggctgctccattccgttccagctttccacaatgattgagacttattacaattatcctgaagcgatgaaggagatcgggatcaactatgcagcccaccagatcatcgatctgatcacgaacggggtggacgggattcacatttacacgatgaataagcccgaaatcgcgcagaggatcttcggaaatattccgacggtgttaaaagagctgaatcatgattaaagaaaatgcactgaaatacttagggcatacggggcagcagatcacggatgagatggaaagcctgctggatgaatgtatccgggaggtgaaacaggtttcccagcccaaggctgtttcccgcaggtttgaactgttcggagctctgccgcagataaaagaattgggactgtctcttcccggggatcagatccgggaggcttttttgcagtgcagccactgcctttttatcggagcaactcttggagtcaccctggagcggaaggtaaaatactacgaaaagagcaacatgacaaaagcggctgttatggatgcggtgggaagcgcttatctggaagcttactgcgacgagtatgaagaagggctggggtatccaaacagatcataccgcctctgtccgggctatggtgatattccgctgtccctcaaccgggagatcgcaagagtgctcgatgtcgggaaaactcttggggtcacgcttacgcccgatcatctgatgattccccagaaatccatgctgggtctcataggtatcggcacgcctgagaggaagaaacagtgcggacagtgtgtgatgagagaagactgtgtatttagaaagagaggccagagatgttactagacagaatcggaaaagacttactcatatttgacggagccatggggacccagcttcaggaggcagggctccgtgccggagatatcccagaagaattaaatattgacaggccggagctgatcatttccatccatgaaaaatatcttgaggccggagcggactttatcacgaccaatacgttcggatgcaatgaactgaaaatgcaggagtcaaagtacggataccgggatatgctgcgtgccgcggtttccaatgcaaatgaggcaagaaaaaatgcaggacgtgagcatgatgcctatatcgtactcgacatcggtcccatcggacagcttctggaacccatgggtacccttacgtttgatgaggcctatgacattgttctttcgcaggtggaaacggtgaaggacgatgtggatgcagtcctttttgagacgatgagcgatctgtatgaggtgaaggcaggtattctggcggtgaaagagcatacgtccctgccggtctttgtgactatgacctttgagcagaacaggcggacgctgtccggaaatgatccggtcacctttgtaaatacggtgcaggggctgggagcggatatgctgggtgtcaactgttctttaggaccggcagaactcgggccgatcattgaagaaattttaagtgtatcttctgtgcctgtgatgatccagcccaacgcaggtcttccgtgtctggaacatggagagactcattatcatgtgaccggcgatgaatatgcccggctgatgcagggatatttacaggacggaatttccgctgcgggaggatgctgtgggacgactcccgaatttatcaggaagttaaaagccgcagctccgaaaaaagcggctccgagaaagattgaaaagaagacaagagtatccagtcagacaaaaaccgtcacattcggagaccgggtcattgtctgcggggaacggctgaatccgacgggaaagaaaaaattgaagctggccctgaaagaagaacggtatgatgaactcgtatcggaggcgatcaaacaggatgaggcgggagccgatgtgctggatgtaaatgtgggcctgccgggcatcgacgaaccggagacgatgaaacatgtggtaaaacttctccaggaagtgatcacccttccgcttcagatcgacagttccaatgcccgggccattgagctggcatgccggtattacaacgggaaaccgctgatcaattctgtcaacggaaaagatgaagtcatggaagctgtttttcctattgtgaaaaagtacgggggcgttgtaatcggtctgactttagatgaggggattcctctgaaagcagaagagcggtttgagatagcacaaaaaatcattgcgaaggcggctgaatacggcatcgggaaagaagagatcatcatcgactgcctgaccctgacggcttctgcacagcaaaaggaagtaaaggaaacgttaaaagccatcgagatggtaaagaagctgggagtccatactgttttgggcgtctccaacgtctccttcggccttccgaaccgtccgctcttaaaccggacatttctcgcacttgccatgcaggccggactggatctgccgatcatcaatccgctggacagggagctgatgggcaccatcgatgcgttccatgtattgttttataaagatatcgacagtgaaagctacatcaggaatcagtcaaatacggcagagacgaagacagcggttcagacggaattcccgctccatgacattatcatccacggactgaaggaggaagtggaggcaaagacgagaaaagaactggaaaagaaagaaccgctggaactgatcaatgaagtgatcattcctgcactgaatgtagttggaaaggattatgagaccggaaagatctttcttcctcaactgatccagtcggcagagacgacaaagaaagcctttgaggttgtaaagaagtgcttcagcgccggcgcaaatgaagaaaaaggaccggtccttatggctaccgtagaaggagatatccacgatatcgggaaaaacattgtcaaagtcgttctggaaagctacggataccgtgttatcgatctgggcaaagatgtgaagattgaaaaagtggcggaggcatggaacaagtatcagccgaaagccatcggtctgagcgcactgatgacaactacggtcgtatctatggaaaaaaccattcaaagactcagggaggaagactgtacctgtccgatctgggtgggaggagcagtgctcacggaagatattgcaaaaaatatcggagccgactactatgcggaggatgccatggcatctgtggccctcctggaaaggattatttaatgcctggaggggtagcaacagtgaaaaacacgaaagaatatttcagatatgcagtcaaaaaatccataccggtattcttcggatatatatttttgggcattgctttcggcatcctcatggcaaagacaggatacgggccgttctggacactggctgcaagcctgtttatttatgccggatctatgcagtttgtattagtgtcttttcttgcagccggagcgcccctgggccttgtggcgctgacaacgctgtttatcaatggcagacatatgttttatggtctctcattcgtggaacgtttccggaaaatgggcagatattatccttatatggtattctctctgacagatgagacgtattcggtcctctgctccattccggacgaaaaagcagaggcggaacccaggatcatgttctggatctcagcgctggatcagacttattgggcagctggttccctgattggggtgctggccggagggctgcttccgtttgattttaagggcatcgaattctctatgacagcactgtttttggtgatttttctggaccagtggaaaaattccaaaaagcacggggcagcggcagcagggctggccgtttcagtattctttttgattctgctgggaccggaccggtttttactgccatcgctgcttgttcttgcgacagtcatgtgccttggttttataagagaggagcaaaagggggaattgaaggaatgatgaagacgatttctattatggcaatagtagcatttgtgacactttttacgagagtacttccgtttgtattatttggaggaaagaagggtatgcctaaaatgatcggatatctgggaaaggtactgcctgcggccatcattgcggctcttgtggtatattgtttcaaggaactgacgatccagcctgcccttcaaaagctgtggagtctgtcggcaggagcggcagtcattctcctgcatctttggaaaaggaacaccctggtcagcattgccgggggaacagtgctgtatatgctgctcatacggatataagagatggaacagctggaacaaatgcagtacgttttgcctgtaagccccggcttttttggggaccctgtgacttgcgcaacttggtcaaataggatataataagtttgatgtgaaaaaaataacaattcattaaagaattatggaggatttatcatgttagtatcagcaaaagagatgttaaataaggcaaaagccggacactacgctgtaggacagtttaacatcaacaatctggagtggacaaaggcaatcttattggcagcagaagagacaagatctccggtgatcttaggtgtttctgaaggtgcaggaaaatatatgacaggatataagacagtggttggaatggtaaatggaatgttggaagaattaaatatttccgttccggttgcccttcacttagaccatggttcttatgaaggatgtaatgcttgtatcgaagcaggattttcttctgttatgttcgacggatcacactacccgatcgaagagaatattgaaaaaaccaaggaattggttcaggtaacaagaggaaaggggatgtctatcgaagctgaagtaggctctatcggcggagaagaagacggagttatcggaaaaggtgaatgtgctgatcctgaagagtgcaaggcggtcgctgacttaggtgttacgatgctagcagcgggaatcggaaacatccacggaaaataccctgaaaactgggaaggcttaagcttcgagacattggatgcgatccagaagctgacaggagacatgcctttagtactgcacggtggtacaggaatccctgatgacatgatcaaaaaagcaattactctcggagttgcaaagatcaacgtaaacacggagtgccagattgcatttgccgaagctacacgcggatacattgaagcaggcaaggacagagaaggaaaaggatttgacccacgtaaattactcgctcctggtacagaggcgatcaaagacatggtgatcacaaagatcaagttattcggatctgaaggaaaagcagacgaataaaaataatatattaggaaagcgcgtctctaaatgagatgcgctttttgtgtatgaaaaattccaaattaaagttactggcagtattttctttgtctcatggataaggaaaaaactggtaagagcattggagttcatggaagacggaacaaagaatattttcctgatcttcagtctcagctggttttttaccatggtattgtttaatgtacaatttacttatccccaaaaccggattctgaaggtcctgtgtctgcttgtactggcgctgaatgtcactttgaattttattattatttactatttggtagtaaattataaaaatataaatgatttagaataattttatatgagtttttgaattatccgcataaacactatatctataagcaatttcaaaactaaaaaacattcattttaccacgaaattaccacgattgaatgagccttgatatggcaataaaaccgataaggaggaatcggctaatgccgatttttccgatttaaaagagaaatagggataccctgcggaaatacgtgcctttcagcatcgtcatattccgcagggtatccctatttctaagatcagtaattatttttgagcgcacaaaacaaagggggctcttccaaataagccacgttttccttatgctgcgttttcttcctgtttgccttcaaacctctggagtttattgcataagaaccgatgatatttattgatatttctacctatcgcatacagcataaactctttgtatactttatctgttgaacggtgattaaaacgccggaaatcatcattttctttgatatccccaaaatgtccttcggtttggattgagcggatctgacgatttaggattcctttctcgctttggatattcgcatgagatttttctttcaattcttcccagcgctcattgatcttcataactttatttttgtcggcatctttttctgggttatatttatacaggcatttcgctttatgctcacagccactgcaatcagcacatccatacacttccaatgtttgtgtatatccttccatttctttttcttctgtgcggatatgtctcagttccctgccatcatgacaaacataataacgttcatcctcaaatatctgggttgtcatgttgtagtattttcctatattttctttataggcacgggtctttctctgttcatgatcctgcagtttgatataactttctatgttgtgttcttttaggaacagtaaattcttttcactacaataaccactgtctgcagtagtttcctttaatatttcaccgaaagtattgatgtgtttttgaatgactgggatcagggtgttgtaatcggttctgtcattacttacataaccatgaatgataaagtagttctctacagcaatctgaacattataagccggtttgagctggccattcatcatgtgatcatctttcattctcatgaaagttgcctctaaatctgttttcgaataactgttacggtctttccccatgatttcaaaactttctgcgtattccatgagttttttgccacatccttcgagttcttcgtaaagctgctggatttcagattttttcttaccttttccgtaaacaaacccaatgccttcaccatctgctatcgttgctaaatttttctggagctttagtagatccaatggagaacagttgtcaatttcgataattttattgtttggtaattttttgtgttttgtaagttttcgcttgcggttcttttcaatcacttcccgcactttatccataccctcaataataaacatctgtgcatttccaaaaccgtattttgcatcatatccgttttcttctaagagctcgttatactttgcataaagggaatcgatggtatcaagaagccctgccagatggtaattgagtgttccacgccatacaaatgtataacggtttgcattggcttctatctttgttccatctataaaaagcgattctaatgtgatcagaccttctttttttaatcgtcgcagcaattgataattcaggtcatctaagatttcgggtgtcagttttttgtttatgaaatcatagaaggcatcccgtttgggctgttcgccctgcgtgagccagatgaatccaaggtctcttttacacaggtcaacaatacggtcaatctcacgaattccccgcatatttgcgtatgtaagaactgcatatttcatgattgggttatacccgtgtttccccttaccagaatactgcgccaataacgctgtaaaatccatttcctccattacatttttaagggtaaagaccggatcgtcatcaggtaaactcaattcataaaagttaaagttcatttttagttgtcctaattcgaaaaatcggttataataatcttgtttatgcatagttacattataacatgtaacggagaggagatggttatggttagccatctttttctctttttatagggataaagttagggaaggcagcgacatcaccgagtcgctgccttcactattcatgactgtctattaaccgacagcccctttgttcttgctaaatgattatgatattgtcaatattagttgacacattttcctcaaggattttgaatcctatgcagcttctttcaggaaattatagtattgctgtcgttttaccattggaggaagacctccattagctgaacagatcctacggttattccagtagctgatgaaatatctccagataagtgttttcagttcatctgtagtcatcttctccgtatcataacggtcatataacagttcggatttcattctggcccacatgctttcgcagcgggcattgtcatggcatcttccacctgcactgttcatgctttgccgaatgccatatttacagatcgcttcccggtaaatccggctggtatactggcttcctggcttcacggtcttctttcgtaattccgtttggtttccgtctgggatgatggttcagaccaatctcttccatgacacgataaacagtgcgttcacttggaatatcaacattttcaggctgtttcaggatcaatgcctggtacatccggattcgcccataggtgtcattacattcgtcttccttctagatttccatcatagcatctgccagcagctgatacttccagggacagtctttgttcgcaagatattgataaaatccctgtctgctgacatgcagaaccctgcagcaaaaggagatatcccccttcaattcgccgtctttcgtttttaaggcaataaacttcattctttcgtttttgctgacttcagacggctcgcagcgaaaaaagcactggcttcctccagaaaatcattttccttctttaaacgacggttctctttctccagttctttcacctgctggcgaagtcggataagttcttcattaagtgtcatggcgctttgtgggctctgtgaacctgctcccagatcaagattgccaagccggctggctcttacccagccatacatggtattcttgggaacccccaactctttggcagccttagcttgtccgatttcctttgcaagtttcactgcctgaactttatattcatgatcatattgcctgttttctgccatttttgttcactccttattctcttgattatatatcaaatccttgagaatggggtgtcaactttttttataccacatcaaacaccttactatgctgtaaaaaggataaatccaaatttaaaagaagatatggaactgttatcgcagttaccgtggataacaggcaaatttgattttggtgatgaggacgagtaatttttttcctcttgcgagaagatacagaaaacaaaaagcccgatcaagagtgcaaagcaccaccaatggtggcaagctcttgacagagctttttcttttctgtgttgggtaatcaagaggaagaaagggataaaatctgatttatggtaaatcagatcgcataaccctccatatctcgttatacgaaggcaatgcaggtatcgcagtttgagcttgtgctacataaggatagtaactggaagattgtaggatagtcaataaggcgtgtatctctttactggggtacacgttttcttgaatttgacaaacctcattttttatattatacttttcttgtgagtatgaaaagtataactaaaccaaaaaataagattggagatgtggatatgtcaatgaaaaaaggacaacatatatttggaacagttaaggtgggcgaaaaaggacagattgttattcccaaagaagcaagacagatttttaatattaaagcaggagataccttattagttttgggcgatgaagaacaagggatagcgattgtgaaagcagacgttctgaaagaattagctgtgaaaatattgaaagggcttggcaaattaagtagtggtatagaagatgaaaaataatattatgattatattaccgatagttttcattttcgatttacttattccttttatcttagcacctacatataagggatataatcatttaacacaagttatgagcgttcttggaaatagtaaagcaccgttacataatgtatataatgcgtggctgatagtctttggaattatcttaatagtaatcaatttcaaagtatatacgattgtttcggagtgttcaagtctgattgcaataatcctttttaccatattactgatttatgcaatcggggggtgtattctttctgggatattctctgttggggaagtaaaaagtcttgctactctttcagaaaaaatacatggttatggctctgttattggttttatgtgcttaacatttgcaccacttttcgtaggaatttattcatacaaaataaacaacattaaattcttttatttcagcatagggtgcttcatattggcaatattgtgtttttcatgttttgttatgggagataagcctaatgctaaaaatacatttttagcatttgaaggcttatggcaacggttatcattactgtttatgtatttacctttggggtgtttaatattgctggaaaaataaattgttaggagtgaaatctatgataggacttaaaaaacgagatataaaaaaggcattgaaagctggtgcagaagctggcggtgtgtcattggctgatgttcgggcaaacattgaagcaacgattgatgaagctatgaacagcaccgacccagaggtgcaggcaaatttcaaaaagtattttggaaacaaacgccctaccccagaagaatatatttatacaattaccaaaaagacaaaagcataatacaaaacaagtgctgtaagggggcttgtactatggaaagttttaaggcataattttatacagtcatacactacctaacggcattttttcaacaactgaatatctcacagctttaaaagctcgtacagactatatgttttgtacgggcttttttatacacctttttttctgtacttttcaaaagttataaacagtatttccactatgaaatatttcgtttatatagttttgctttggcagtaagggggtgaaattatgaggacatcttctttcgagcatatcgtcagattacagtttaatgctttcatgatgattgttattaaaggcacattatcaaggcatagaaggcagattgctaggcgttctaagtatgaagtattattttgttaattgcttgaaatgaaacagattgaacatagtgtgaatgataactattcgcatgaatttgtatcatttcaagtgatgaattttgtaattcatatatctgatgaagaattaagtgcagcattgaaagaattaacagagaaacagcgtaatgctatcttgttgcatttctttcaagacatgaacgacagagaaatttcagaactgtatcatgtatcacattctgctatcaacagcagacgagatagaggactaaagaaattacagaagttattaaacgaaaggaaataggaaaaatgaaaaaagattatgactatccctcttacgaccttatttgcagagtgactagcggagatgaaaaagcggtcagagaaatattagacttttataatgcttatatctctaaaatatgcttgcgaccatgttattacgcaaatggtactgtacatatacaagttgatgaagaactaaagggagaaattcatgcgtaaatgatgaaagctattttaaagtttgaaatcagagtgaagtaatcatttaacaagaacaaagggagatacacagctttcatgtgctatctcccttatcggttttattgccatatcaaggctcattcaatcgtggtaatttcgtggtaaaatgaatgttttttagttttgaaattgcttatagatatagtgtttatgcggataattcaaaaactcatataaaattattctaatttattgacaaaaaaatgtcgccgtattatagtattcctataaaggaacacgaacggaggcgcagaatggaaaatgttgaatgtctgatgaatttcggactgaccaggcaggaagcgaacctctatgttcttctggttttggagggagaactgaatggatacgaggccgcgaaaaaaagcggcatctccaggtccaacacctacaacgcgctggcagggcttgtggaaaaaggggccgcatatatgtccgaggaagacaccgtcaaatatcaggcagtgcccgtggacgagttctgtgacaataagatccgggatttgagaaggagcaaaaaagaactggctgtaaaacttccgaaacagaggatcaataaaggggcatatctgaccatcaaaggggaaagacagatccttgacaagtttacgaatatgctgagggagacaaaagaaagggtctatgtgtctgcctccaacgaaaagctgaacatgttccgggattgtctgacggacttagtaaaccgcggcatcaaggtagtgatcattaccaatgagccttttgagcttaaaggagccatcatctatctgacggagcataagaaagaacagatccgcctgatcacagactctacctatgtgctcacgggagaccttgtggaccggtataatgcagcctgtctgttttccagcaatcataatctggcagaggtgttcaaagacgctctggccaacgagataaaactattagaaatcaagaaagggaatcaataaaatggcaaaaagaccgtttgtagcaaaagaacaattagatcaaatcgtaaaaaagtatccgactccgtttcatttatatgatgaaaaaggaatccgggaaactgcacggaatttaaataaggcattttcctggaacaaaggatttaaagaatattttgccgtgaaagcgacacctaaccctacgatcttaaagattttaaaggaagagggctgcggaaccgactgttcttcattgacagaacttatgatgtccgaccgctgcggtttcggcggaagtgagatcatgttttcttccaacgacacaccggctgaagaatttgtgcttgcgaaaaaattgggagccacgatcaatctggatgacattacacatatcgactttctgaaagaagcagcgggaatcccggaagtcatttcctgtcggtacaatccgggcggtgtgttctctctggggacagatatcatggataaccctggagatgccaagtacggcatgaccagagctcagatgacagaggcgtttttgaaactcaaagaactgggcgtcaaagaattcggaattcattctttcctggccagcaacacggtaacaaatgaatattatccgacgctcgcaaaacagctgtttgaattggcagtagaacttcagaaagagaccggtgtgcacatcggatttatcaatctctcaggcggtgttggagtcccttaccttccggaccaggagggcaatgacatcgcagtgatcggtgaaggagtacacaaggcttttgatgaagtgcttgtccctgcgggcatgggagatgtgaagatctttacggaactgggccgctatatgctggcgccgaacggccatctggtgacaaaggcgatccatgaaaagcacacccacaaagaatatatcggcgtggatgcctgtgcagtcaacctgatgcgcccggcgatgtacggagcttaccaccatatcactgtgatgggaaaagagaacgagccgtgtgaccacatgtatgacatcaccggatctctctgtgaaaataacgacaaattcgctatcgacaggaagcttcccgagattgagaacggagacttgctggtgatccatgataccggtgctcatgggtttgccatgggatataactacaatggaaaattaaaatcagcagagattttattgaaagaagacggaagcacggagatgatcaggagggctgagacgccggaagattattttgctactattgaaggatttaacttctaaagaatactatgatgaaagaaggcaggttctgtatgcagacaggatctgtctttttatgtgggataatttttggaaaaagcttgtagtacaatagtcttatgatataatgattgcaacggttccgtacacttcccaatatccgctttctgtatatgattgcaggacaaagaatataagacagctgactgattggtgtgatgtcctgaattatatatttgtcaaagaggataagttgtatttggcagcaatggatacgaaaaaaacaatcattacttcataatggtgcgacagagaaacaggaaaaccaacagatttaacatgggatcacgatctctttgtggattacgtgacatataatcctttgacaaagggtttgtactgtaatctttcttctgacagagaattatataaaaggctcaatccaataaaccggaaaccgcagcagcgaatctgaataacctttctcttgcagttgcacatttgaatcagaagtcggcagcttaactgaattctattgaattgataaaagatattgcagtcaatcttgcttttttgtaaagattgaggtcatcatgggtcatatccctgtttacggaagtgaacatacttttcggatgacttccgtattataataaatattctcatggacacacctaagattcagaagacggccttttatgccaagtgctgtctgtgcagagtgtttaagtctgtcatgtccgtgactccaaccgagtatatcaacagtaagcggctggactattcggtttatcttcttacgcagacatcgaaagagatcatagagatcagctgtaaaaaatgttctctcgtgcggatgcagccgcttcccttgatcttacacttttcacctgcttcatccatcatatgctgtacgacatccggtgctgctccccgaggttcatatccggtgagaccgtatttgtgtgcagcatcggcacaggccttcaggtccgcagtgaccttttcatattccactgaccgtatcagcccgaagtttgcgaccacatcgatctctgttacggtatcgtatccggccgcgatctcaatctgtgtggtcttggattcggtggaaatggttaccggacaaagccccgtgtcagtgccctccacatatggtgtacaacgttcaatataacccggattgatgcagatcgtggcgcatcctaatgttaccccgtcttttgtcagttctatgatatctttttcatagtatatctcctgtattttcattgtttatcactgtaattgcaatatatcatcatttcaggtgcatttcttgtcttataaaatcattatattgtaatatattgatatgatgaggcggctttcctgtttctggaacaacttaagaacttcttcatatgtggaaagcttttggcatagctttcaggcttgcggatgtgctacaattttaataagcttcagtagaaggagagaggacattgttgacagagagacagttgcaattagtaaaataccttcaggaatgtgacggttatacgacggcgggaaaactggcagaggtgtttcatgtcagcagcagatcgatccgcaacgatctggatgcggttcaatattatttgaaaggactgccggtggaaatcgaacgcacacctaggctcggtgtccgtctcattgtcaaaaagggatttgatatcacaagcctttatttcagcaatgagatcaaagtctattccagggaagagagagtggtcatcatcactgtgctgctgatgatctcagagaaagtgaccatcgagcagctggccgagaagcttcaggtcagcaagaacacggttgtacaggatctgaggccggcagaagagtttttgaaaaagcacgaagtgcggctcatcaaaaagtcctactacgggatgtccctgaaaggtgacgaagaacagatacggaatacattgtttaatctatacataaagacggtcagtgagggctccctgaacattcttcctattctgaaagagtatggggcagcggacccggatgaagggatgcgcatgatccggagagtggaggcagccatgggcatccggtttgcggatgaatccatcggggaactggaaagcatgattcttgcgtcactgtgccggattcggtgggggtttcatgtccggggaggcagcttggacgatgcggacggcatttacagagaagcgatcctttccggactccccggttttcaggtgacaaaaggggatctggactattttgtcatgctgttccagagtacgaaacggatggacggggagagtcttgaaaattgggatgaggacggcagggtgaggcaggccacagagcagttgatccggaagttttgcagtgatttaaagatcagcagtgagattgaccctgagattcaaagacagattatgatgcatttaaaagtggcggtgttccggctgaaaaataaaataaagatcaagaatcctctgctggaggatataaagtattcccattcctttatgtatgagctgacggaacggctgctcaaagggcaggaagagatgctgggcgtggtatttcccgacgctgagatcgcctatacgaccatgtattttgaagtgctgttccaggaaaacttcagcttgaatctgtcaccggaggtcgtgctcgtctgcgggggaggcacggcgacagcagtgctgttaaaacagcggatttcaaaatattttccggaactccgggtcagaaaaatctgcagggtcagcgatgtggaggaggaaactgaaagaagccggccggactttatcatcagcacagttccgctgagtcttaaaaatcagcaggtcattcacgtaaatccactcttaaattctcctgatattgaccgggtgaaaaatattatttccgtcctcgcatacaacagaaagaaccagtatctggtccacagaatccaccagacgatgcagagggggatcggggaccttttaaaagaagaatactgccggtttgatgcagagacagatgactggaaggaggccatcgccatggcctgtaagccgctgatcaaaaacggccttgtgaagccggagtatgtggaagagatgatccacattgtacagaacctggggaactatatggtatttattccggagattgctttcgtccacgggaggaaagacaatgtccgggaaaactgcatcagcctgatgaagctaaaacatcccattgattttgggagcaaggcaaaggtagatgtgaaagtcatcattgtcctcggaaatatcaccgagaacgagaatctggcagatttggtccggattctggcatgggagaacaacatggaaagaattaagcatatcagttcttatgaggaacttctttctcttagatctgaagagggaggcggcagcctatgatttgtgccgaaatcttggaggaagtcagtgaatatacacaggctatcagaaaaagctgtgagatactcgagcggtatggcatggtgaccggggaatattaccgggggatcattgacaatatcggagaatacggtggatatttctatctgggggaaggggtgtgcatgccccacgcaaaaccggagacgggtgttttgtccacgggactgtgcatcataaaactaaacacaccggtggattttgaagggaagaaagtccgcattttttttacgctggcggccagggatgaggcggcccattttgtactgatgaagcagatcgctggcatctgttcggaaaagcagagcctgaaaaagatgctggaatgcagaagcagtgaggaaatgcttatgatgatggagaaagaacaatgaaaaggatcatgacagtctgcggcaccggcctcgggtcaagcttcctggtggaaatgaatatacagaagattctgagagagcttgggaaagagcaggagtttgagacatgccattcctcagtatatgagatgagtgccatggacgcagactattttatcgtggcaaacgatttaaaggacagtattcctcctgtggaacatttgatcgtactggaatccctgattgacgaagatgaattgagagagaaactgacaacgttcttgtcttaaagataaaagagggatatatatatgttaaaaatgctgagagacctggtactggaaccgtccatcgtggtcggaggcatcgtctttttaggtctggtgctgcagagaaaaagtctggaggccacggtaaagggaactcttaaatcggtcatagggtttatggttatccggatcgggggaaatatcatcacagaaagtgtggaaccttttggaaggatgtttcagtacggatttcatgtatccggagtgatcctgagtgtggaaggagccgcgggaattgccgtgggcaagttcggaatggagatttccgttgtcatgctgcttgggatgacagtcaacctgattctggccaggatcaccagattccgctatgtgttcgtgaccgggcatcagacgttattcatggcaggcatgatcgtcgtatgtatgaaaggcgcggggatcagcggatggattttttatgccatcggagccctggctcttgggattctgatggtattttcgcctgccatcctgcagaaatatacgaggcagatctgtaaaaacgactcggtggctttgggacatttcggaggaagcgcttattttctgtctgcgtggctgggaggaatatacggagaaaattcaaagtccacagaagagatgcacattccgaaaaaactggcgtttctgcgggattcttcggttaccgtatccattacgatgattgccatgtatgtggtggcggctctggcctgcggcagtgaatttgtagaacagaatctgtcagaaggaaaagattatctggtctatgccatcgtccaggggctgacctttgccgtgggatttactgtggtcatcaccggtgtgcgctggtttattaatgagatcgtgcccgcggtgaaggggattgcggataactggattcccaatgccaaaccggcagtggacagccccgtcgtctttccgtatgcacccaatgccctgattgtgggattcatctcgtcttttttgggagggcttatttccctcggtattatgatcgcatgtaatctcaccgtgatccttccgggggtcgttccgcattttttctgcggcgccacggcaggagtctatggaaattccacgggaggaagaaggggagccattctgggcggtttcctaaacggagtgctgatttcttttctgccggtgatttttctgccgcatttgggggaactggtaaacgcctctgtcacatttccggatgcggatatgggctttgcgggagtgtttctgggagactggctgaatcggatcggaagctacgggactctgacgatcctgatcggcattgtaatcatcatgatcctgatccccgaaatgatggatgacatggaagaaaaccaggacgaatggtttacatttgacaccgatgagatcttaaaagaatcaaaaatgacgaataagaaataacagggaaaagcggggatctgcgttgggcaggttcccgcttttccgcatttcaggaaattaattggtatggcggcagttttcttatgccggtagactatacttatcagataacagaaaaggaggaaagtattatgttaatttcagcaatcttagtcgcgctgatcgccattggaagccagtggtggttcagccacacaatcacccgtacatggctgtatccaatctgggcgggattccttgtagcggtagctatgggagaaccggtcctcggaatgaaggccgcagcctatatccagctcacataccttggatggatcacagccggaggtaccatgccgggcaacctgatggtagcgggagtgttcggaacggcgctgaccatcatttccggggcatcaccgaatctggcaccaacctttgcggtgccgttcagcctgctgggaattctgatcaaccaggcctacatgaccatcaacagtttttgggtacataaggcagatcagtacttggagaaaggaaatatccgcggattaaggcttatgaactacctgccgtccggaatcactgccacagttctctacggaattccggcatttgccctcgtgtatttcggaggagattttgcaaccaacgccttaaaggcaataccggagccgatgatcgcagcgttaaatgtggttggggcactgatgccggcacttggaatcgcaatgctgttaagctttctcggcaaaaagaaaatcgtggcattcttttttatcggttacttcctgaccatctacgcaaaagttgataccatggcggtgactgtatttgcggcggctgtagcagtcctgatctatctctttacgggaaaatcagaacaggccgcagaggcggaacaaatcgaaacagtctccccggaggagaccgatgtgcagaccggcggcaaaaaacttttaaaaaaagatctggtcaaacattttcttctcggatattccagcgagacctgttataactacgagcgtctccaggcactgggtacgaccaatgccatggtgccgattgtaagaaggctctatgagacaaaagaacaacaggcaaaagcgttaaagaagtatatggtatttttcaacacggaaccttcatggattggaaccgttattcacggagttacagcatccatggaagaacagtctgccaacggagcagacattgacgcagaagacatcaatgcggttcgtacaggattaatgggaccgatggcgggaatcggggacacagtttcccagggtatcgcttatccgatcttagccggaatcgcctgcagcctggcgctggccggaaatgtagccggaccgatcctgtttgaggttgcgtacaaagttctgatgatcggtatgggatatgccatgtatatgatgggatataagcagggaaaaagtgccatcgtaaaaatcttaagtgcaggaactttaaacagaatcactgaagcattcagtatcgtcggactgatggttgtcggaaatatggcggctaccagagttaatatcaagactccgatcgcatttaaagtcggggaagtaggaatcaatcttcaaaatatcttaaattctctgctgcctggaatgctgcctctgatcgcgacgctgcttgtgtggaagctcctgagcaagaaggtgaagccgacctatatcatcgttatcatctttgtagtaggcgttatcacttcactgatcggcctgctggccgtggcatcatagcagacggaggaatgagacatggttggagttttattaatcagtcacggactgctctgccggggacttgctgacagtgtctccatggtagcaggaaacatagaacagtcagaatgtatttccctgaagccgggccaggaccccggagagtttaaggaaaaggtgaggcaggcagtggaagagctggacaccggcatgggagtccttgtgttgacggatcttttaggagggacaccgtttaacagcattgccatgctgtgccaggaatatccggcagcggtcatcaccggagccaatatggctatggggatcgccgcggcgcttcagagggaggaggacacgacactctcagaacttgcgaagatctgtgaacaggcgggacatgatggcataaagaggctcgacattcaggagaaaggaacggcgtgaagatgaaagcagtgagactaaataaaatcggagatttccggatggaagaaatgccccttccggagataaagggagaagaactcctcgtgaaggtggaggcctgcgggatttgcggctccgatcttcccagggtgtttgagctgggagcacatgttcaccctattaccataggacatgagttcgcggggacgatcgtaaaagcagcaagggaagaagaccaggaactggtagggaagacggcggccgtcttcccgctcatcccatgcggagagtgtgaattttgtaaaactgggcactatgctcagtgtgcgaattataactacctggggtccaggtgtgacggcggatttgcggagtactgcgtcatcccgtcccgctggaatctggtattttcagaaaaccccgaagttacaaaggaagaactgagtctggtggaaccggccacagtggcacagcatgcggtgagaagatcagggatcaaagccggacagaccattgctgtcttcggggcaggtcccatcggtatcatggcggcccgatgggcagaacttttcggtgccgggaaagtggtcttgtttgatataaatgaagaaaaaattgaatttgccagagagcggggactgaccatcttaaattctatggaagaagatccgggagacggactcgcaagagtgctgggaacggatcatgtggatgcagtcatcgagggaaccgggacttctgcagcccttaaccagtcagtggagatcgtaagaactttcggacggatcgccatgctcggaaatccccacagagatacttctttaaagcttaagaatcacagcagcatcctgagaaaagaagtcgatatcgcaggcgtgtggaattcctattacgcacagatgcctctcaatgaatggcagtatacggcagagatgatcgacgcgggcagactcaaggtgaatgacctgatcacccatacgtccgatctggaacatttgagtgagctgtttgagcagatttatcataaagaaatcacgatctgcaaggcaatttacagctctaaggcctgagagaaaggggacaattttatgaaagagaagttttctgtctccctgatgtgtatggattttctgaatgtcggggaacagcttaacatattaaatgactgggtgggaatgtaccacgtggacatcatggacggtcattactgcaaaaatatcaccctgtcaccggatctggtgaagagttttaagaaggtctccaaagttccgctggacgtacatctgatgacgaccaatccggaggactggattgacccggtggcagaggcaggtgcggatatcatatctctgcacgctgagacgatcaacgggcaggcattccggctgtacaacaggattgaggaactgggattaaaagcagggcttgttttaaacccggcaactcctctttctgaggcggctcattacctgaaccggattgacctgctgaccatcatgaccgtggatgttggcttcgccgggcagccgtttatcgaagaaatgctcgtcaagatccaggaggcaaagcggataagggaagaaaagggataccactatcagatacagatcgacgggtcctgcaagtcttctacgtttaaaaaactcaccgaggcaggtgcggacattttgattctcggaagctccgggctgttcggactggacaaagacctgaaaacagcctgtgtgaaaatgacggaaagttataaagcagctctggagtgacagggaggataaagtggaatataaagattttaaagaattgattctgggagaacttgaccagtcactggcagcggtagacggacaggaggtccgggcactgacggagatgatacttcatgcggaaaagatatttgtcacaggtgtcggaagagtcttcatgatgatggaagcttttgccaagaggctgaatcatctgggtatcgatgcattttgtgtgggagatgtgaatgagcccgcgatcaccgagaaagacgtgttaatcgccggttccggctcaggagagagtctgattcctctgggacttgtgaaaaaggcaaaacagttcggcgcgtcggtgatccatatcggttccaatgcaaaaagctccatggctccctatgaggatctgttcgtgaggattccgtgcaggacaaagcttgatctgccggacgagatcgagtccgcacagatcatgagcagcctgtttgagcagagtcttcttttgctcttggatgcggcggcgctgatgatcatgcaggaagagcaaattgacgacgtggattctctgtgggagaagcacgcaaatctggaataggaggatacaaagatggaacaattattgcttgcaagggtagatgaccggctgatccacggacaggtgatgaccgcgtggatgaagcttctgcctgcaaaagaaatattgattgcagatgataaagtggcaaaagacccatttatgacacaggtgctgactatggcggctccggccggggtaaaggtgaaagtttactccgtagaagaggcggcaaaagcgctgaaagacggcctgaaagtcccgtccattatgctggcaaaaacaccgcttacctatgaaaaaattgtagacctgggagctcacatccctgcaattaacatcggaggcatggggatcagcggcgaacgaaagactttgtataaaaatatcgcagccgaccctcaggaacgggatgcgatcagaaagtttctggatcagggaatccaggtgaagattcaggtgattcctgccgacaaggttgtggatgttgccggtctcttatagaatgggggatacagggatgaaagctatgagacttcatgaaatagggaaatttacactggacgaagtggaagttccaaagccgcagggacacgagatccttgtgaaggtggaagcctgcgggatatgcggctccgacattcccagagtctatgagctgggaacaaaggtttatccggttaccctcggacatgaatacgtgggcacggttgtgagtgccggaagtgaggaggatcaggaacttattgggaaaaccggagcagtctatccggtggttccgtgcatggaatgccccagctgccggatcggccagtatgcccagtgtgagagctacaagaatttgggttccagaacggacggcggctttgccgagtactgtctgctaccttcgaggaaacaccttatattccctgaaaatacaaaggtatctgccgaacagctggctcttgtggagcctgcctgtgtggccctccatgcgattcgcaagggggagatcaaaggcggagatacggcagtgatcttcggtgcagggcccatcggcatcctgacggcccgctggtgcggactgttcggcatccaggccgtattggtggagatcagtgaggaaaaaacagagtttgccagggaaaaaggactggaagtcataagtcctgcggacggagagataccggaacagatccgggcaatgaccggaggacacatggcggacgcagttatcgaagggaccggaagttctccggcgtggaatcaggcagtggaatgtttaaaaccttttggaatgctggtgcttcttggaaatcctcatcaggacacagtgctcaaacttgacagccacagccagatactgaggaaagagttacggcttaccggggtgtggaataattactataatgaccttccgttcaacgaatggcagtataccgcggacaggatcgccgataaaagtctgaaagtagacgacctgatcacccacagcgccgatcttgaacacctgaaggaattgtttgaccagatatataacagagaaataaccatatgcaaggccgtctgccggccttaaaaataaaagtctgtatcactcctatagtcggaggaggatacagactttttcatttcagtaggaaagttctgcgaccttccccatgaaataaaaacgctctgcaggttgtgcacagatgcgtaaggaaatcatttgactacgtcaaatcgcatctggcacgcaaagtttaaaagcccctcaaagattgagattattcataaaatcagaaaaacgaaacatactgatgaaaagtaaaaaacaaacaatggagataaacacatgaatttgtatgacattatggggccggttatggtaggcccgtccagttcccacacggcaggagctgtcaggattggcctgatttccaggaagcttttaggagagaaagttcaaaaggccgagattttatttcacggttctttttttgccaccggtatcggacacggcacagaccgggcagtcatcgcgggacttttgggaatggcacaggatgacctgaggattccgaaaagccttgagctggcccggaaacagggaatggaatggacgtttggaagagcgcacttgaaagatgttcatccaaacagtgtaaagctgtgcctcacaggagaaagcggaagaaaacttgaaatcgtggcgagctctcccggaggcggaagagtggagatctgtcagatggatggtctttacacgtctttttccggtgatatgcctgtactgatcgttcacaaccaggacagccccggacatgtgtctgcggctgcatctctgcttgcagacgcaggaataaatatagcgtccatgcggctctccagggatcggagaaacggcagtgcggtcatggtgctggaatgtgatcaagagataccggaaaaaacggtgagacagatcgaaaagatgaaaggaatccaaaaagccgccagtctggcgggcatggattgaggtgaaggaacatgggctttatatcgatggcggatatggaaaaggcggcagcagctgcggggattcctctctggaaagcggtcatggaggaagacatgaaagagcgcagtgtatcaatgcaggagacaatggataagatgagggagcgttatcatgccatgaaacatgcagatgaggactatgagcagaatttaaaatctttcagcggcctgtccggcggtgacggtgcaaacatgcatcggtttgtccgggaaggagaagccgtctccggcggctttatggggatggtcgtcacaagagcattgaaaatgggagaatccaacgcctgcatgaaacggattgtggctgcgcccacggcaggagcctgcggcgtggtgccggcagtctttctgacgtatgaacagttttatcggataccggaaagaacgatgatcgaggggcttttcatggccgctggagccggtcaggtcattgcccgcagagccagtatttccggtgcacagggcggctgccaggcggaggttgggaccgcgtctgctatgtgcgcggcggcgctgacctccattcggggaggaagtaatgaacagatcctttcggcaggagcatttgccatgaaaagcctgctcggactggtctgcgatcctctgggaggactggtggaaattccgtgcatcagaagaaatgtggcgggagccgtcagcgcagtggcctgttcggacatggcgatggctggaattcttacgagagtgccatttgacgaggtgatcgatgccatgggagaaatcggagaaatgatgccgggaggactcaaagagacaagccaggcagggcttgccgtcacagagaccggaaaaagggtcgctctcgatctggcccagaggaatcagactccccaatgttaaaaaaatacccggcctgtaaatgttaaggccgggtataagtatctttattttaatttagtaacggttctggctgttgcacatcttgatcttttcttccacaacagctgccattgcttcttttgcttcctttgtgtaaatccttggatcgttggcatccggattttcaaccagggtctttctcagttcctgagagtaaggaatttttaattccgtagcaatgttgaccttacagattccaagctcgatcgcacgtcttacagcgtcgcccgggacaccggatgcaccgtggagcacaagcggtatagatacttcctcacgaatctctgccagacggtcgaagtcaagctttggctcctctttatataaaccgtgggcggtaccgatggctacagccagggaatcaatgcccgtgcgggctacatagtcggcagcctgtgcaggatttgtgtacatggagtccttttcgtctaccacaaggtcatcctcgcgtccgcctaaacgtccgagttctccctctacggtaacatcatggagatgagcataagccacgactttctttactttttctatattctcttcatatggaaggctggaagcgtcgatcataacagattttgtgccaaggtcgatggattctttgataccgtcaaattcttcatggtggtccaggtgaagtgccaccggaacattatattttttagcagttgtctcgacgatcgcctgaagataatcacggtttgcataagaaaatgtacccggagtgcctgccagaatgatcggagagccaagctttgcagaagtctctgccactacctgaatcgtctctaagttgtgaatgttaaatgccggcacggcatatcgtttttcctgtgcatctaataacatatgtctggttgataccatcttactcatattcatcctcctaaagctttcctgctttttgtcttagtttaaccatttacattataaaaaaaccgggggtgaaaatcttttcaggttatgaaaacggatgaaaatcatgtataataaaaaagatctttcacacagacaggagggacgagtgatgattattgaaataaacagcaagattgcagaaaatctgtccaagaccgaattgggagttgtcaactatatcaatgacaatgaggacaaactttcagacctgtccatagtagatattgcttttgaaacattttcctccccggcaaccgtgtccagagccatccgcaaatgcgggatcaatgggtttaacgagctgcggtataaattaacggcaaagacggaagatacagaagtgaaagacttgaatgaaatcatgaacaagtctctgatcgaggcgacttccgtgattgagcatatgtccattcccaatgtgctggatattctgcatgccatgaaggatgccaaaagggttctgatcttttccagagggcctacacacttggtggcgcaggagctgagcatgaagcttcaggtgctggatttttttgtggtggatgtggaagacccgcagatcatgaggatcatgtcaaagaacttacaggaagatgaggttgtgatcatcctgtcgttaaacggggagaccaaggagctgatcgactcagccaggaacgcaaaactcagaggctgtaaggtgatcacgctctgctgcagcagtaccagtgagctatttgagtattcagattatacatggctcggatacaaacactctcacattgcaataagaaactatgaggtaacgtccaggcttccgctgtacattatgtgccgaatcctcgtagactttttagtcgagaatatagaccataaaaaataaggcccaaagaggccttattttttgtccattcttgtattctattcatgatatccaggggaagacgacttcttcggataaggtgtgacagcatctgtacggtccatcagataatccaggctggtattataaaaatctgctaaaagcagcagattttcaactgtagggattgattcccctgtctcatattttgaaatagtactttggctgattccggtctccatttgtactcttaattgggtgatatccctggaaacccggatgaactttatattcttcatttctgttacctccatactatgattctctcaaaaaaaagatatataatttatgataggatgatataaattattccaatattgaatattaaggctaagggtacagaatcacttggttttcttacattgtaatatttctcagaggaggtagaaaaacttgacatttattcttattaagaataatatattcttgtatcgaataaacagatatggattgaaacaaaacaatgtaaacaacaggaggtacgtagtatgaaaaagaagcttacggggaaacgtcttcgtaaatcggcagtgagcctggcattatcaatggcaatggtgtgctcgacaggggcaccggcttttgctgcaggaccagtctcaaataaggcagtaaatgaggcagtgaaaagagcgacggaaggactgagcttctccgttgggggagcagcctatgagaatggggcttccattccttggggagcaactgtcaaagtggagggaactacagatgaaagtacatacagctggaaacaggatggagaagccattgagggtgaggagtcttctatagatatctctgggaaagaaacggtaggacacacttatacagtgacggagacgtcagaagacggagagaccacgtcagaggcatcctttactgtaggaaaaaaagaggtcaaaaaattatcgttttccgatgaaaaacagacatatgatggaaaaagccatgagctctccatcaaaaagattgacggtcttgatttttctgaggaagagtttggaactgtaataccggaatacagtgaggatacagtaaatgccggaactgtgacggtgacggcgggtgtgaacaataagtattatgaaggaacagctgcgggaagctatgagatagagagagcaagtttaacagggaaaagcccggaagtaagtgtctcaggtgatttcacttatacaggggaacctgtggtgcccggcaagtcttcggtaaccgtaaaagtaaacggacagattctgagggataaagattatacagtggagtggtccgacaatacaaaaacaacagatacaccaaaggccgtgatcacaggtgcagaaggcggaaattatgctgacagcagtgaacaggttgaggtttccggctttaagatttcagcaaaagcggatgagagtctgacagccgatcagacagccgatcttacctataccggatcagctctgactccagtactgaacgtcatgtccggcgataaggagctgtcaggtgacacagattacactgttacttaccacaaaggagaaacagcagagggagatacagtagagccggaagagttgatcaacgccggaacctacacagcccagatcaccggaaccggcgattatgaaggatcaaagggaagcgtgacatttaccattgctccgaaaaaagtaggagaaatgaccgtaaagctggaggatgaaagtcaggatatcacttatgacggaacggaaaagaagcctggcattaaggttacatatgaagacggagaagaaaagacattagaagctgcagatttttcagtagaatataaaaataatgtcaatgctgcgcaagcagatgctgaagcggctcctactgcagccgtcaccgtcgggggtggaaattatgaatatactggcagtgatcctctggaggtaaaatatacaattgaagcatgtgatatcagcagctataaagtggcattcgcagaaggtgcagagacatcatttgtatacaatggaaaagcccaggctccggccgcaaaagatatcatcgtgaaagagggggatgacagcacaccattaacttcagatgatttcacagtaaaaccggaggagttaaaaggaaccaaagcggaaaacggcatcaaggctgtggtagaaggagcgggaaactataaaggaaccgtggcaggtgagacagcggaggctcttacctacaacattattcaaaaatcgatctcagatgtttccattgaaggcatccaggataagtaccgccaaaaggacgacggttcagctattgacgagccagaggtcgtggtaaaagacggtgatacagaattagttctagatactgactacactctggaatatcagacggaagatggaacaaaattagaaaatggtgcggctgacctaaagaatgcaggacaatataaactcgtgatcactgcaaaagaaggcggcaactataaagattcagcggagaaatcatttgagatcacagcggctgtggatatttcagatgaagctgtaaaaggtgaagtcaccacttcctatatttatgacggaacagccaagaaaccggcggcagaagatatcaagttgacagacggaaaaggaagtgtgatcccgaaggatgcctaccgtatcagatcttataaaaatacaacaaaggcgggagacaatgcaagtgttaccgtagaaatactggattcctgcgcggactataaaggtacaaaagagattaagtttaccatcgctccgcaggatatttctgaaaattacagcgacaaggtaacaggattggatgccgtaacctataacggaagcgggcagacaccaacagtagaggtaatgggacttacggaggaggattataccgtcatattaaattccggaattgagatgctgaatgcacagacatatgatgtcgagatcaatggaatcggcaactatacaggaactattaagaagacatttacagtaaatcctgccaatgccgctggaaagctgacggttccgtatatgctggaggatcaggtgtacacaggttcagagatcaaaccggatgtaaacttaagcgccataaacgaggaagatgaatctacatatccatcagtaaaccgttatgccgacaatgtaaatacgggaatggcagttgtatacacagatgcagtaggaaattatacaggtacatttgtgactgtatttaaaatcactgcaaaggatctgagggatgcaaagatcacagctgcggatcagacctacacaggaggtgaattaaaacctgctgtgacagttacagacgggtcaagagttctaaaggcaggcacagattatgatacagcttatacaggaaatatcaatgcgggaactgccaaagtgacagtgaccggcaaaggtaattacaaaggaacagcagaaaagacctttaagatctcagcgaaatccatcgcaggtgcaaaagtgaccgcggcagataagacctataccggaaagaatctgacgacttctgtcacagtaaaagacggcagcaggactttaaaatccggaacagactacacgctttcatacaaaaacaacaaaaacccgggaacggcaacagtgaccgtgactggaaaaggaaattatgctggaagtgtatcaaagacattcaaaatcacagtaaaggtttccaaagcttccctgacaagcgcaaagaaaacatccaagaagggccagctgaaaattaaatggaagaaggtttccggtgcgacaggatatcaggtatatgctgcacagaataaaggctttaccaaaaaggtgaagaaggctaccatcaaatcaggaaaaacagcaagcaccacattaaagggactcacaaagaagaagacttattatgtacgcatccgtgcaacaaagaaaattgcaggaaagacatactacggtgcatggagtacggtaaagaagacaaaaacaaaataataaatccatgaggatatgaaatcccggaggctttacaggcttccgggatttttctaattttatggtatttggtccactttgttccgttttcaggatatgaaaagattttcatggaatacttgtctataataaagactgtaaaaagagattgtattctatggaggagcagtatgatttatacgttaactacaaatcctgccatcgatatgaacatttccacaaaaggaatggaacgtgcaaaagtaaaccgcacattcgatacggtttacactcccaatggaaaaggtgtcaacgtcacgctgacattaaagcattatggggtagattccacggttactggattttttggaggattttcgggaaaatatattgtagaggaactggaaaaaagacaggtggcggtcaagccggtctgggtcggtgacacaacaaggatcaatatatttttaaatgatggagagggcgaattcaaatttgtcaacagcggatcgtttgtcggaagagaccagcaggaagaaatgctgaatctttttgagacagccgaagatctgagctgccttgtgatcagcggcagtcttccgcctggaatcgaaccgagttattatgaaagtattatgtcaatctgtaaaaagaggggcattgatgtggtgctggatatcagctccccgaaactgaaagacttattaaaataccagcccttgctgatcaaaccaaacgatgaagagattgaagagatcttcgggatcaagatcaaggacgaagaagacattctgcatgtccttacctttctgaaagaacagggggccaggaatgtactgctgacgctcggaagcaaaggagcgtatttcagtaacggagaagatgtgtattattcatcttcccagccggttaagttattaagctcggcgtgtgcgggagatgccgcattggcaagctttttaagcctttggctcgatcatccggaaaatgttgaggatgcattgaagcgttcggctgccacaggggcaaatgtggcggagagcaacgcactcggtgattttgccaaagtagatacttactttcacaatatcaaaataagaaaggtggagaaatgatatgaaaaaactattaggtgttacaggttgcccaaccgggatcgcccatacttacatggcggaggaagctttgaaggaagctgccgaaaagctgggcgctgaaatgaaagttgagaccaacggagctgttggtgtcgagaatgaattgactgctgaggatattgctgaatgtgacggaattattgtagcttgtgataaaaatgtagacatggaccgttttaacggaaaaccagtcatagaagtgccggtctcagacgggatcagcaaagcggaagaattagtgcagaagatgcttgatggaaacgtttcagtaagaggtggggaagtgaaggcagccggaagcgaaaagaaagcagaagaaggaaaagattctattggacatcagatctataagcatctgatgaacggtgtctcccatatgcttccgttcgttgtagccggtggtgtattgacagccatctctttcttatggggtatttattcagcagaccctacaaatgctcagtataatgaaatagcagccactatcaagaccgtcggcggtacatctatgggaatgatggttcctgtgctggcagcattcatcgcccagtcaatcggtgaccgtccgggtatgatcgcaggttttgtaggcggtatgatcgccaacaccacagggtctggatttatcggagccatcatcgcaggtttctttgcaggatacttatgtaagtttgttgtaaacgctttaaaaggactcccaagacagctggaaggtttaaagtctatcttctttataccgattatcacagtggccatcgtaggtattttgatgcagattaccgcagggccggtttccgggatcaacaagggaatgatggatttcttagcaggattacagaactccagcccgatcatcttaggacttgctgtaggctgtatgtctgcatttgacatgggaggcccaatcaacaaagcggcttatgtcacaggaacaacacttttagcacagggaaacttctactttatggcaggtgtgtccgctgcatgtattacaccgccgttgatcatcgcgcttgcagcgacatttgcaccaaagaaatttacaaaatctgaccgtgcagcaggacttgtaaactatgtattaggatttacacacataacagagggagcgattccgtttgcagccaaggatccggtaagggtacttccgatcttaatggcaggatcttctatctcagcgattctttcctacgtgatgaaggtccaggttccggcacctcacggcggattcttgatccttccattagtacatccggctgtcacatgggtattatgtatcctggcaggttctgtagtaggcgcagtactttatgttctcactgcaaaggatgtagaacagaaataaacgtttaccctactgggtattagaaaggttggtaacttttatggaaattatggaattatttgatgagtcaacaatgaatctaaacttacagggagagacaaaagaccagatcattgaagaaatggtaacacttttagatgaaggcggagtgctcgctgataaggacgactataaaaaagcgatctatgccagagaagaacagtcctccacaggacttggatttgacattgcgatcccgcatgccaagaccgcagcagtaaaaactgcacgggtggccttcggaaagtctgacaaaggatttgatttcggagccgaggacgggacaaaagcacacctgattttcatgatagcggcaaccgatacagacagcaacctgcatctacaggcgctggcgacactctcaagaaatttgattaaagcagacttcagagcgaagcttctggcagccaatactgcaggagaggttatggatgtgttaaagactttataatagcagatatcagaaaaagcggcggaatttatttctgccgcttttttagaacgtttacaggttcaaaaattttattgatttacacttaattgataagacctggtttgatacgtattgtcttttcctttaggatcttttactgttgttatttttatattttttttgattgttgctctagctgccttatgcgagtcttttagcagatgaaaataatcagcaatcccttgggcatccttctcagccatttcttgaattttttcatcggaagaaaaatatgattgaaattcatctatattatccatatatccgtgttcaataataatagcgatcatatcctcattaattccaccttttacgatcgcataatagtcacataatctgccatttctataggtatttctgttctcagacaatctacgcagcagccctctgtttttcagcccaagttcactgatgcggtttaatatatttgcacctaattgctcttcctcttgtgccagattttctttttcatttccgctggcaaccaaaacgtaagcgccgtcttttgcattaacaatgctgcctttggcattatgatgaatacttatcaatgcgtccgcctgatctttttttgctttttccactcgtttctttaaagatatatttttgtctgtcttgcgagtcatagaaacagtaactccctgatatttttctaactctgttttcaagtacaaagataattttaaatttaaggttttttcataggttactgtcccatctgctgtaatctgggcacctgtatcaacaccgccatgtccgggatcgatttctattctcactttctcaaccttatccttatttgaaactgtcacttcggttgccttcgcagctgtccttttatccgttttattcggcacatttattttctttgcatagattaaaaagataagcacaccacaaacaacaaaaacaaagaatgttagttttttcatgggcagcctctatgattcgtcagacagaaattcattgtatgttcggatttccttcgttgaaccgctgaaagatgctccgcggtaaaaacagtcagccatataatctgcctggccctttggattattactcttatcatctgctttatatttaaatttaagaatgtaatcataggttccattagaagcaatgatcatatattgacctatggttttatcactatttaagtgaccgccataaatttttctgcaaaaggctcctgactttttaaccccctctgttggaaacttaaaataaaagtgggagaattcatctttataatcttccgccagattttttacttcctgctgcgcggatccagcggttgccttttgagaaaatacagtatattcagtcaccccgtcgtctgccgaaaaaacatatttcccatctttattaatatctacacggttgaagaagttcttaggatacacaaagctatatcccccgctggtattgcaagttacctttttatataattgggtatttaggcatttgctgtagtcattggtactgttggcatccactgcaattttactattggtgttatcgttgttttttctttctgtagctgactcggatgtagtcttttttgctgccgtagttttttcttcctctgcagctgtgttttcagttgtgacgttatcaactgtgggagcgcttggcgtctgttctttatttgcagacacatagcaaacaatatttaaaataatggataaagcgactgcaatgctcaaaccaagaatgattttcttttctttttgtctcatatttatctccatttctttctcaaatgtatcactgtattataaaaagcattatgattacatagctattttccaggatccatccacaaacaccatataaaaatcttcatcaatggagagcgtatcttttgtagcttgtccccagagttcgtttgtataagtatattcacaacttgcattaaatgaaatataaggctccttaaagttctttgccggactttccataatttcacctgtttgaggctgagtctgaatgtctgctttggagttcttggtacctccataaacagtataggaagagataaagctttccgcatcttcttttgaatagaaataatcttggatctcatcagcagaaacatctttttttcccagatagttggtccactcttttaaaaaatttatcactgtgttttttgctgcctgaacttgcttattgctatacttaagtgaaagttcttttaaagaacccgtgtttaactcataagtatcttgtgataaaaaatcatccttatcctcaaaggttacagtgtgattgccttctaatacttcaatatcataatatttttcatcttcctcttctttcagataaatatctttgatcctagttccgtctatagaaactggacactgttgaatatatggaatttctacttggacagtatcaacctttaagtcagctaattcccactggtcaaagaaaaaatatctttttttatttaacttttgaacattgcagtagtaatcagacccaaaataaacctgtttttctgctgagtctttatcattactgctattgatctcacctaactcacctgttacatttgccatgactttttcataagaggctttcgtaataaattctgtttcggtgatatttgtcatgtcatagattttatcccactgttgattgttgtaatacttacgatattgctccgctgttttttcggcggtattaaatttacttccttctatgtaaaaaaaaccaacactgatacataaaatgaaaataagaattccaataatggttttacctttctttgagaattcttcccctttcttttttgtctttgccggttttctttttgtttctttttttatatgcaaagaggaaccacactcttcacaaaaatttccgtcgggtacatcttttccacaatttggacaaatcataattttatcttctcctctataatcccataaacatatttcttccatagttgcttactatattggtaagagatgttttaagaacaatatataaaacaagactcacaacaataaataccaccgcaagaatatacatagttttttctttatctgcgcctttcacttcatcaaccgcttttcccatcaaaaaagtagaagcaagcttcccgctgatgaaaacaaggataccgaatcctggatttaataacaggcagatgatacctagtactaaaaatagaatattaattgctgctgttgttgccggtacggtcataaaatcaacataggctgcgtcactcttgcttatcattttttccaatgcccaaagcacaagtgtcgtcagtgcgttcattccaatgacaaacaaaagtgcatagaaaaatatttttggataagagaccatctgacgtccaaaatatgatgatcctaaagtggatgatacaagtatcatcaaacaaatgcctgtaataatgccctcacccagccaagttactgcactctctttcagcgaaaacgatgcagtaatttgttttgctccggaggcaggtttcactagtactttttttattccgcttgaaattttatttttatcaatatcttgaaagaaacttgtttcatcttctttgatctgacaagtacaaacctccccgtcttctaacctttttccgcaaaatttacagtatttcatacataattcctcccttttctcttgtaactgtattattataccaataattgactaaaatttcaattacctcatcatcttgtaaaacgattttatgaataaaaaaaggtctcatgcaaaattgcctttgcatgacaccttttgttttgacatgcttatctagcagatactgcgtccgtgttctacatgattggagtgaggcattctaagagccgaacggaaatcatgtggaaaatgtcacaccaagataacttccgtgagttcactcagtgttttataaacagcagacggcagatctttatccgtgataaaatagtcgatatccttccagttggcgtactgcaccagagagcagatatgggccttggagctgtcagagatgacaacaatgatcttagactgggggatgatggcctgcttgatctgtgcatctgtgaattctgagactgccggcccgttgtgctgctcaaatccgctggtccccagaaatgagatatctaccttgatagtgttgataaagttggtggtctggaacccttctgtggacatattgttcgggttcagctggccgccggttaagatggtcacgttgttgccgttatttaaatggtaagtggtgttgatggcattggtcacaatggtataaccggatttctggcttaaaagctgtgccatgcactgcattgtgcttccggcgtcaagataaatgacaccctgttccgggatcaattccaatcccttctcacagagggcatactttacggagctgttttcgctgacccgtgtttcgatggggatcgggcggaagcttgagaccagggtggcgcccccgtggctgcgctctatagccccgatctcctgaagatgagtcaggtctcttctgatggtttcttttgtcacttcaaatttatctgcaagatcgccgatcttagcacttcctgtactgttgatatattcgacgatttccttctgccgttcttttgcgagaagttttcccatgtccgttcctccttttttactgttacactcatcataacagaaattcaaattcatttcaaatttaaatccacaaaaacaaaaacaaaacaacaaaaacaaacgtaatttatgtcagagtattgacataacaaggaaaaaatcatataatttacccataaaacaaaaataaacggacataaaacaacgtaaacaaaatttaatgaggtagatcatgaaaaattggaaagagtatgtgtttgatgtcaatggatttcagatcaatacgctttacagcgaggaaaccatagaaaccattttcctgcccatgctgagaaaattcaccggtatgcagaaaaaactgggccggagactgatcgtatttctggcggcgccgccggcagtgggaaagacaacactgtccaagtttctggaatatctggctgtgcagcaggaagatctgacagagatacaggcgataggactggatggttttcactaccactcagattacattaatacccacaatgcggtcgtgatgggaaaagaagttcctatgaagaaagtaaagggatgtcctgaaacttataataccgggaagcttgaggagaagcttggaaggatcaaagaagaagatattctctggcccatatatgacagaaacatccacgatgtggtggaagatttggaaaaaattacgaaggacattgtgctgatcgaaggcaactggctgctccttgatgaggagccgtggaagacattaaaggataccgcagattatacgatattaatccgctctgaagaagagacgttaaaggaacggctgatcggaaggaagatgaagggcggccttacgagagaagaggcagaagactggtacataaacagcgacagcgtgaatgtgagaagggttttggagacttctctggatggggatttgatgttaaaggtagaaccagacggagattatacgaggaggataaaggatgaaatcaacagcggcagttcttgcagggaaaaatcaggtttatgtaaaggaagtggcccttccggaaatcggagaagaggaactcttggtaaaggttgtgtcaaacagcatttgcctgtcaacttataaggcggcactgcggggcggggagcacaagagggtgccggatgatctgagtccggagcacccgacgattaccggccatgagttcggcggatacatcgtagaagtgggagaaaagctgaaagaccgcttcaagccgggagaaaaattcgtactccagccggctatgggacttccgagcggatattctgccggatacagctacgaatactatggaggaaacgcaacctactgtattattccgaaggtttccatcgacattggatgtgtacttccgtatgacggtgattattttgcaaatgcatctctggcagagccgatgtcatgtatcatcggagcatttcacgctacctaccacacaacaccgtatgtgtatgaacacagaatgggattaaaggacgggggaagtgtggctcttctgggatgtgcgggtccgatggggatcggagccattgattatgcactgaacgggccgtatcattcaaagcgcatcgttgtgacggacatcaatgaagaaaggcttgagagagcaaaatccctgattactccggaggatgcggcttctaaaggtgtggaactcatttatgtgaacaccgcaggaaaagaaaatgcgacagaagaactgaaagaattaaacggtgggaagggatatgatgaagtattcgtattcgcaccggtggaatccctcatcgagatgggagacgatcttttaggaaacgacggctgcctgaatttctttgcagggcctacggacaacaacttcaaggcaaaatataatttctacaatgtccactacgaaggaacccacatctgcggaacttcaggaggagcgcctgtggatatgatcgagtctctggaactgtctgcggcaggaaagatcaatccgtcttacatggttacacatatcggaggcattgacgcggcaccggatacgatcctgaatctgccgaagcttccgggaggcaaaaaactgatctacccacatatcaagatggaactgactgccattgaagattttgaggaattgggaaaagagaacgagatgtttgcacatctggcagagatatgcaaggcaaacaataatgtttggtgcagagaggcggaagaatatttactcgacactttagcaccggaagagtaagagagaatgacgaagaagagccctgtttaatttcagggcttgcccactttgttctcctgggagagctgtacctaaaaatatcaatatatgtttttattttatgtgaaactgttgactttgagtggggtctaaatgctatcatggaaaaacatcaataatgatgtttgaatatttatgtaataaacagaaggaggccccacattgtatctgttatttttcatactgccgatcctgatcctcataccgacaggaatatatttatatgttttcttccgcaggattctgagccttttcttaaaaagggacgtacgcctggcgaaaggactgagtgcggctttggcattggcctgtgttttttctgcctggccggcctatggatggggaggagtagccgtcctgcatcttgcaggagtctccctggtcattgagctggtcaattttctcatcaaaagagcaccgtttgttttcaaaaaatgggatctgatttacagaagcggagtactgtcttttctcatcatttcggttgttttttcttacggatatatgaatatgcagaagattgagaagaccggttacaggatcgggacttctaagattcatcaagaggaaacactcaggatagtcctgatgtcggacatccacctgggcgttacgatgagtgccgaagacctggagaactggtgcagtaaaatacagaatcaggagccggatctggttcttttggccggagatatcttcgatgaggatacagggagagtagagatggaacgggcggccaaagctttgggacggatgcagagtacttacggaattttttatgtatatgggaatcatgattccaatcaatacagggaaaagccggagtacacttccggacatctcaggaatactttagaaaaagccggagtccatgtgctggaggatgaggtgtttaagacagggaatcatatctgcatcatcggaagaaaggatgccggtgaccaggacaggaagagtctgaaagagatcatgaaagatgcaccggaaaacagtttcagaatcctaatggatcaccagcccggagatctgaaggaaaataacaggcaggggatcgatctgcaggtgtcgggccatacccatgcgggacagatctggcctaccgggcagttgatgcagcttcttggaatcaatgagatcaactatggcttccggaagaccggaaatcttcagacagtggtgacatcgggcatggcgggatggggatatccgatccgcacgggaggacactgtgaatatgtgatcatagatgtggtgtcaaaggaatgaggtttcaccacggcgtgttttgtctctgtattcggttccccactgcgccatggagtccaggatcggttttaagctcaggccggtctctgtgagagaatactctactttcggagggacctgaggatatccttatttttaaggaggtaacaagatggaatggttgaaaaaacttggagcagccattgattacatagaagataatctggataaggaaatatcgtatgatgaagcagcccgcattgcgtgttgttctccctattattttcaacgtattttttcgtatgtttcgggtatgtcactgtctgaatacatatgttgctgaaaaatgacacaggcggcatttgaattgcagcggaaggactgtaaggtaatagatattgctctgaaatatggatattcttcttcgacttctttttaatcgggcattccaaaatattcacggtattacgccgacagcagcaaaatctatgggcagcattttgcaggcatatccgtcaattcagttttcaatcaaaatatcaggaggaagttcgatggcgtatcacattgcagaaaaacagcctttgcgtatcgtgggtatccgtattccaatggttgaggatacggaagaaaatctaagggcagttcctgatttttggaaatccacggtgcagggaaatcaattatggaaaatatacagattatccaatcaagagccgggcggaatattggaattagtgtattaccttaaaaggcgaccattatgaaatgggagtgaatgaatatggtcttgcagttgcgatgacatttgtgatgactgctcctcaaaagatacaggcgggatttaattcttgcttcattgtgaggtatttgcttgaaaaagcgaaagatacgaagcaggcaatttcattgctttgtaatttacccatagcttctaattgtaatattttacttgcagataaaagcggcagaatggtagtggttgagtgcacgccgtctgtcaaaaaaatccgaaaagcagaagcttttgatagtggaagaattgtttgtacggtcaacagttttgcgtctgatgatatgaaaatgcatgatgacgtacatgggaatgactatgattcccacaaacggtacgaggttgtcatagacagtttttcttcagggaagataaaagatgattatattgaaaccaccaaacatctcttaaaaggtgattatggctttatgtgccaatatgataatgagccagactttgaaaccgtttggagttccatttttgatttagggagtttaatcatttaccgtgcagagggtgacccaagaaaaaagaaattcgtgatagataacagactgcatgatattggtgtcaaatgaggataattgaaacttaacaaagcaaagcatagaatatcaggaaaagacattgtttgtttactatactatgattacggaaggaggaaaaacatggaatgggtgaagggattgcaaaaggcaatagactatattgaaaaccacattaccgaagatatagattatgctgaagttgcaaaacaggcgtattcttcgagctttcatttccagagggtttttcatattatctgcggctattctatcggtgagtatatccgcaacaggaggttgtcacttgcaggagcggatttatcttcggaaaatgaaaaagtcatagatatagccctaaaatatggatataacagtccagaaagcttcagtagggcatttacaaaatttcatggaattacgccagtccaagcgaaaaatgaaaaacttacactcagatctttttccagagtttccgtaaaaatcatattagaaggaggaacaacaatggattacagaattgagaaacgagaagggtttgaggtcattgccaaacgagccagatatggaggaggacaggaaatcagccagaagaatatccatgcaacatgggcggcttgcggagcagatggaacgattgatactttgtgcaaatatatcaatccagaaaacatcttcggaggagcaatcgttgggatatgctttgacaatccgattgagggggactttgattatgcaatcggagcggcttatacaggcggcgatgtggtagcaggattgacgattgagaaagtacctgcaaatacttgggcagttttcccttgtactgggagaatgccagaagcgtttcaagagttgtatcggaaaatttatacagaattctttccaaccagtaaatatcagcctgcgggcgggatgtgcattgaggtttatccgagtgctgaaatttacgataataatttccattgtgaaatatggctttccgtagaggaaaagtaaagccattgaaagctgctatctgtcatgccttaaactgacggaggaaaagaaactggacagtattgtattctgctgcatatccacgggagaatatcattttcccaaccggaaggccgcagaaatcgcgctgaatacggtacttgcttatctggacaaaggaagcggcttaaagcgtatagttttcaatgtatttaaagacatcgactgggaaatttataaaagcggttttacagcatgatatctcccggacaaaaaaccatttctctgtgccagtcctttgcatacgataagggctgagtgaagaatataccggcagtcactttccggtgttgaggaggagagaatatactgccggtgcaggttttccagccatggttcaaatctgcagatgcctgagcacgattttatatgccggctgatctgattcgttctcagacagtttgagaagaccaggtggagccggcgttcatattttatgtgctctttcagagaatagcgaaattctttgttatggggacgggtaaaagaatcagcgagataatgcatcatctcaccggcccggaaccagccggcaaaagtatcccgaaagcctgacgaataagcctgtcccatcagatgtctgcgggagtcataactgtgtcctttcagttctgcggcattggagccgcccagataggagaaaggattgagatcgggcagaacatttcccaggataaatgcaaaggttttggaattgttcaggaacattcggcgggccagcagttttgaaagtgcaaaatgatcttttgtttccataggatacctctatataaaaacagtgttttcgggtttgtcttcatagtatctgcgaattgtgtataaatagtgatggaagtttaaaaaaattcgcaaggggatatccttttagagatcattcagcaatgcttctttcaccgcattcagaagcctgaaaaaagtacggtgaagcatgcggcgatttccggagaaatatccagcagtctttcgtcttctttcgttctggtactgcggttttctttgtcctgagagaaaaatgcttcggatgcctcctttattgtcaccgagccggattccgagatatcggggacaatgcccggaaaccggatgtaggaaagacaggacagaatcaggctgtcaacctcattcatcccacattcctgaaagcttacatctcccctccaggcgagataatcaaagatatttgtggacataggcaggctcctttgcgtgcagagacaatatccttctttcatcattatactgtaaaaacaaattcctcaaaacactgttttatattataataaactgaaatacacgagaaaggattttggaaacctatgaatcaaaatacaaaaggcgtgatctttacaatgttgggaggaatcttctgggggatttccgggattatcgggaaatatctgtttgacgaaaggcagctcacggccgtctggcttgtgacgctgaggcttttgtcggcaggactgctcatgctcttgttggcggtagtccaaaagaagggggatatattccgtgtctggaacaagaaacgaacggcagtgagtcagcttgtgttctgtctgttcgggatgacagcctgccagatgtcttattttcttgcaatccagtattctaatccggggacagctactgtgctccaatacattgccccggcgcttatcatgctgttctgtctggcagtagaaaatagaaagccgaagcgcctggaagtgatcgttctggtctgcgtcatcaccggggtttttctgttggcgactcacggagatcccggcagtctggccgtcacaggcagggctttgttctggggacttgctgccgcagttgctctggctgtctataatattcagccggaaaaactactgaatgaatttggctccctggagacagtgggatggggaatgttcatagggggactgcttatgatacctgtgacgggcttttttcatgtccccggtatatgggacatgaaaacggtcctcatgacactggccgttatcatcttcggaacggttattccgtttggatgttatctggaaggcgttcgcatgctgggtcccgtgagagccagcatgtttgcgtgtgtggagccgctggtggcggcagtcatgtccgcactgctgctgggagagatttttgttggcatggatatcctgggattcactctgattatcggaggggtcacatccctggcagtgtttgaccgggcataaaataaggcgggcctgtctgctcccttctgtgtggctgaaaaatttataaataatcgctgttctgttggatatatttgtgcaatatgctataataaatctgacataacgtgtgggagcacagagaactaacggagatctaggagggcaatatggagagatacattatggcactggatgcgggcacaacgagcaaccgatgtatcctgttcaacagagaaggcaagatctgcagtgtggctcagaaggaattcactcagatatttccgaatccgggatgggtggagcatgatgcgggagagatctggtctacgcagctcggagtggcggtggaggccatgcagaagatcggtgtcacggcggaacagatcgcgggcatcggcatcaccaaccagagggagactacgatcctttgggacaaggagacgggggagccgatttataacgccattgtgtggcagtgccgcaggacctcacagctctgtgattccctgaaagagcagggactggaagaaaagatacaggataagaccggtttgattattgatgcctatttttccgggacgaaggtcaagtggattctggaccatgtggaaggagccagggagagggccaagaagggagagattctctttggaaccgtggagacctggctgatctggaagctcacaaaaggaaaggtccatgtgacggattattccaatgcatccagaaccatgctttttaatatcaaagatctcacatgggataaggagatacttgagatacttgatatcccggaagcgatgcttccaaaacctgtccagtcaagtgagatatacggtgaggcagacccgtcttatttcggcggtgcgattcctattgcgggcgcggcgggagaccagcaggcggctctgttcggacagacctgtttcaaggcgggcgaagccaagaatacatacggcacgggaggattccttctcatgaatacgggccggatgccggtgaattcccagcacggactcctgacaaccatcgcatggggactggacggtaaggtggactatgcgctggaaggatctatttttgtggcgggagctgccatccagtggctgagggatgagttaaagctcattgactcctcccaggattccgagtatatggcccaaaaggtaaaggacagcaacggctgttatgtggtgccggcgtttacgggactgggtgctccccactgggaccagtacgccagaggaacgatcctcggcatcacccgcggagtcagcaagtgccacattatccgggcgacactcgagtccattgcatttcaggtcaacgatgtgctgaaggccatggaggccgacggaggcattcatttaagttctctcaaggtggacggaggcgccagccagaacaatcttttaatgcagatgcaggcagacatcagcggtgctccggtacaccgtccggcctgtgtggagacgactgccatgggagcggcataccttgcaggccttgcagttggctactgggacagcaaagaggagctgtccgagaacatggatattgactgtgtctttgaaactcagatcagtgaggaagaaagagagaaaaaggtatccggatggaaacgggcggtccgttattcttacggatgggcaaaagaagaataggaaagttgattttttcaccagtcttcacactggtgaaaaaatatgacaagattggttggaccaattaagcgggattgtaaaaaatattgacttagagtgagctccaggtgatatagtaagtccgggagcacataatggccggcaggaagatgcagcggccttcaaataaaaaagtaaggagtgcacagagatggaagcacatgaagtattagaaaaagtcagccggggagaaatgtccgtaggggaggcagaagcatttttccgtcgggagccctttgaggatatgggatatgccaaactggatacccacagaaaattgaggaacggcgccgccgaggtggttttctgcagcggcaagtccgatgaccatctggccggcatttttcaaaggctttgggaacagaatggagaagtactcggcacgagagcctccgtaagacagtttgaacttgtccggaaaaaacttccggaacttacatatgatccgatctcccgtattatgaaaattgaaaagccggacaaagaaaggattgggaggatcgcggtctgtacgggaggcacggcggatattcctgtggccgaggaagcggcccggacagcggaatttttcggcaatcacgtggagcgcatctacgacgtgggagtcagcggactccaccggcttttgtcccgcctggatgtgatccagagtgccaactgtgtggttgcggcggcggggatggagggtgctctggcaagcgtcatcggaggacttgttgacaagccggtgatcgcagtgcccacttctgtgggctacggggccaatctgcacggcattgcggctttgctcacgatgattaactcatgtgccaacggcattgcggttgtaaatattgacaatggatacggtgccggatacatggcatcacagatcaacagactgggggaatgatcatgaatcagacactttatttagaatgttattccgggatcagcggcgacatgatgacagcggccctgctggatctcggggccgatgagaaggtccttttggaggctcttgaaagccttcccgtaaagggatttcagacagaggtgagaagagtatcaaaggcaggactggacgcatgtgactttcatgtgattctggatcacaaacatgagaaccatgaccacgatatggaatatcttcacggacacatccacggtcatgaccattttcatggagatcacggacatcattctcatgatcacgaacacaggggtcttacagagatccttgagatactttgcagggcaaagatcacggacggcgccagagagaaggcggtgagaatttttgagatcctcgcagaggcggaggccagggcacacggcaccagtatagaaaaggtccatttccatgaggtgggagccgtggactctattgtggatattacggcagcggctgtctgcctcgataacctgcagattgacaaggtcattattccggtgctttatgaggggagcggatctgtccggtgccagcacggtgtgatcccgatcccggtgccggcggtcactgccatcacatccagatattcacttcctgtacacatgacagatgtgcagggagaactggtcactccgaccggcgccgccatcgcagctgccatccggacttcttcccggctgccggaacggtttgtgattgagaaaaccgggatcggggccggaaagagagagtatgaacggccgagcctgctgcgggccatgctgatccgggagacagaaaacagcagcgccggcgactttatatacaagctggagagcaatattgacgactgtaccggggaagctctgggatacgtgatggagcagctgatgaaggcaggggcaagagacgtccattatacccctgtctttatgaaaaagaacagaccggcctatcagctcaatgtcatctgcaaggaggaagacatagagaagcttgaggagatcattttccgggaaacgacgaccatcggtatccgcagacagaagatggagcgaagtgtgctgaaacggcaggtgaaaacagtcagaacttctctgggagaagcccgggtaaaggtatgctttatggaaaacggcatgagagtctatccggagtatgagagtgtcagggaactgtgcagaaagaatgggctgtctttccaggaaacttaccaaaagatcgcagaggaatgccatggacagatatgaggaacactgtgcaaatttaaaagaagcagtcagaggttttgtaaaggaagatgtggcgcttgctttttccgggggagtggacagcagcctgctcttaaagcttctatgcctggcagcggagaaaaccgggaaaaaggtggcggcatttacaatggtgacaaaacttcacccgtccggggatataaaaattgcagagagagttgccagggaagcgggagccgttcatcaggtcgttcatgtagatgaactttcccatgcggggatcatagataatccggagaacagatgctatctgtgcaagaaatatctgtatacagaactgcttaaatcggcggaatcgttagggatacagactgtactggaaggaaccaatgcggatgacctgcacgcctaccgtcccggaatccgggcagtaaaagagcttgcaattctgagtcctcttgtgcaggccgggatgaccaaggatgatatccgcaggatggcatcggaatatgggatctccgtggcagagcgcccggcaagtccttgtcttgccacgagatttccatatggggccagactgtccggggagaaaatgaaaatggcggaggaaggggagaagtatctgagggcaatgggcttttataacgtccgtgtccgtatatacggagacatggcgagaatcgaagtagatgagaaggagcttccccggctgatcaaaaacagagaagctgcggtaaagcggctcaaggaaataggttttacatatgttacagcggatctggagggattccggtccggcagcatggacactcatttgaaacagagaaaggagaaataagatatgcatatggcagatgcgcttgtggcccctgcggtggcaggcaccatgtatgcctgttctgcggcggcagcaggatgggcggtaaaaaaagtacaggaggaggacgacccgaaaaaagttccgctgatgggggttatgggagcctttgtgttcgcagggcagatgatcaattttacgattccgggcaccggttcttccggccacctgtgcggaggcatgctcgtgtcggcagtactgggaccatttgcaggtttcctgaccatgatcggggtactgctgatccagtgccttctttttgcggacgggggacttctcgcacttggatgcaacatttggaacatggcgttttatggctgttttataggagccgggcttctctggaggcggatcatgaaaaacggaccggataaaaagaagattacatatgcatccgtcatcggatgtatccttaccttacagctgggagcactttccgtgacagcagagactcttgcttcgggcattaccgagctgccgtttgcagtatttgcggctgccatgcagccgatccatctggtcatcggactggtggaagggcttatcaccgctgcagtgctctgtttcttgtacgaggccaggccggagcttatctggaccggggactccgggaaatctgcggcaggcgcaaagaagccgaagctctctttccgaaaagtgctgcttgcgctcacaggagcatttatactgatcggaggagcattatctctggcggcatctgcaaacccggacgggctggaatggtccatacaaaaaataacagggtccgcggagcttgcggcgtccggtccggttcacgctgcggcggggaggatccagagtctgacctcccttctgccggattattctatcccggaccgggagacgatgcttggaacttctctgtccggcatcttcggcggactggcagtcatcgtattatgtatagccgtttgttatctgttcggcctgtttagaaagaaaggacgtcatgagcagaatcaatgaggcagttcatgaaatacaccatctggatgccatggcttcaagagaggggcggatcaacaggattcatcctctgagcaagcttctcgtcaccgtctggtatatcacttttaccatgtcatttcctgtctatgaaccgggcggaatcttcggcatgatcctgtatcccgcagtaactatgcgggcaggaggcatctctgcggtcagaagtataagaaaattaaagccggttcttctgctcgtctgtgcagtggggattgccaatccgttttttgaccgggccgtactcttccgggccgggcctttaccggtaaccggcggcatgatctccatggccacactgatgctcaaaggagcatttgcggtgctggcatcttacctgctgatcctgacaacgtctatggagagcatttgttatgctctgcgtctcctgcatgtgccgaagattatggtgaccatggtgcttctgatttatcggtatgtgatcgtgctgctgaaagaagccgaacggatctcccaggcgtactccatgagagcgccggatcagaagggaatccattaccgggcatggggaaccttactgggacagctgatgctaagaagtatcgaccgggcccagacggtctatgagagcatgctgctccggggatttgacggaagtttccgtctgtcaaagaagcagaaaatggacagaagaagtgcagtgtacctggcaggctggctgggtatcgttgttttgctgcggtatgtttctgtttttaaacttgccggaagtctgttagaatagaatacggaggaagtatgaacaaaattgaagtaaacggcctcaccttttcctatgaaaaaagagcctcatcaagcagaaaaaatgtgctttccggtttaaattttactgctgaagatggagagagcatcggactgatcggggccaacggagcggggaagtctacactgctcaaactcatggtagggcttctgacagactatgaaggagagctcagaatcggaggaatccgggcagagaaagcgtcgctggcagatattcggaagaagacgggatatgtgtttcaggattcagacagccagctgtttatgtctactgtgtatgaagacgtggcatttgctccacgcaattacggactctctgaggaggaaacaagagagaggacgctgagagcactggagagtgttcatatggagcagatgaaagacaggcacatctaccggctgtccggaggagagaaaaaaagggcatccatcgcatcgatcctgtccatggagccggaggtgatccttatggatgagccgtcggcggctctggaccccaaaaacaggcgcagcctgatccatgtcctgaacggactttccgggactaagatcattgcgtcccatgacctggatttcatctatgatacgtgtgagaggacaatcctgatcgcagacggaagacttgcggcagacggacccacggaggaaatattaagggatcaaacacttctggaagacaatgggctggagctcccgctgtcattttccaggactttggaatgaatggaggaaagtattttgaccatcgcagaagtaagtaaaaagtatgacataactgcagatacgctgagatattatgagaggatcggactgataccggctgtcccgaggaagccgaacggcattcgggattatgaccaggcatcctgccagtgggtggaattgatgaagtgcatgcggaaagccggggtgcagatcgaggcactgattgaatatgtggagctgtttcgccggggagatgagaccattgacgcacggaaaacaattctcatggaacagagaaaacgtctggtccggaaaatgcaggatatgcaggagactctggaacgtctggattataagattgagatgtatgaacggggaaagatgtcagcagaatatcagatggactgatatccagagatatagagattatttcttcctgaggaagacgtattttgacagaagccttaaattctgaattctattctcccttctcttgtccgaagcaggaaaatgctttccggaactggcctaaaagaaatggagacggagaggcattgctgggccgttccataatcgtatccagattccagaagtcaggataatccgcggcatcatcgggatggactaactgacgggcaacaacttgggtcatcaaagtggataaagatccctcttctgggggaataatatatttgtcagaaagatggaataaaactttgaaggaatcttttgtgagattcagttcaaataattcattataggcagagagattcgtgagattataaaacaggtttttattgcccttttggaaagacctgctgaagctccctgttgaaatgcacgatcctgtaatgatcatctatgatataaatgctcgtttccgaagtaaaattattagtattcatatgtatattcctgtcaggccaatttactatatagtattttttgtgtaaatcagtcaatctcaagagaggaaataaagaaaaagagaaaaataaattgacaagacagacaaaactgaactataatgatccaaaaagcgtagattgagaaaagtagcatagattatcgcttacagtgagcaggagacagtgggaaccctgcagagtgaatccatgtgaagaacactcaggagctgcaatctgaacgtccataggatcagtaggtgcgtcgcaggctgtgcgttattcagcataccagagaggctgtaaaagcagcaaatcaggtggtaccgcggaacttgtacagttgtccgtcctgaatgattttttaggatagacgactttttttattacaaaaaagtctaacatgatgaaagaaaaaggagaaaaaaatgtcagatatgtaccgcagcaagactatggataagatttctgagagcgatatcgggtcccagttaaagatcgccgggtgggtggaaaatatccgtgaccacggcggagtgtcatttattgatttaagagatatgtatggcgttatgcaggtcgtgttaagagacggaagtcttttaaatgaagtgagaaaagaagaatgcctttccatcgaagggatcattgagcacagggacgaggagacttataatccgaagattcccacgggaacgatcgaactggaagcccataagattacagtgctcggaaaggtatataccgaccttccgtttgaagtttcagggtccaaagagatccgtgaggatgtccgtttaaaataccggtatttagatttgagaaaccgcaaagtaaaggacaatatcaaattccgctccgaagtcatcagtttcctgagaagaaagatgaatgatcttggatttatggagatccagacaccgatcctctgcgcatcttcaccggaaggggcaagggactatattgttccgtccagaaaatataaagggaagttttatgcactccctcaggctccgcagcagtacaaacagctgctgatggtatccggcatcgacaaatactatcaggttgcgccttgtttcagagatgaagatgcccgcgccgaccgttctccgggagaattttaccagctggactttgagatgagttttgccacacaggaagatgtctttaaaatcggtgaggaagtgctggcagagacctttaagaaatttgcaccggaagggtccgttgtgacagacacgccattcccggttatcagttataagcaggcgatgctggaatttggaacggacaaaccggatttaaggaatcctctcaggatcgtggacgtgacagactttttccagagatgtactttcaagccgttccacgacaagacagtgagggccgtgaaagtccacgcaaatctctcaaaaggattccatgaaaagctccttaaatttgcacagtccatcggcatggcaggactcggatacctggaagtaaaagaagatatgtcctacaagggaccgatcgacaaatttattccggaagatatgaagagcgagcttgcaaagaaggcacatcttgaggcaggggacgtaatcttctttatcgcagcaagtgaaaaacttgcctgtcagtttgcgggacagatcagggacgaacttgccgcccgcctggatctctgtgagaaaaatgcgtaccgtttttgttacatcaacgattttccgatgtatgagacagacgaggagacagggcaggtgacctttacacataatccattctctatgcctcagggaggacttgaagcgctgaatgaaaaagatcctctggatattctcgcataccagtacgatatcgtctgcaatggagtggaactttcttccggtgcggtgagaaaccatgatctggatgtcatggttaaggcatttgagatcgcaggatatgatgaagaggcattaaaagaaaaattcggagcgttatataatgcattccagttcggtgcgcctcctcatgctggaatggccccgggagtcgaccgaatgatcatgctcctcagaaatgaagaaaacatccgcgaagtgatcgccttccctatgagcggaactgcacaggatttgatgtgcggtgcgccgggagaagtatcggagcttcagctcagggaaacacacatcaaggtaagggattaactgttaaaaaagccgtacattcagaaatgaatgtgcggctttctgcatatatatggtaaataataaagtttgtacagggggaaggccttttgggtacgcttcttcagattatttttatcaaccttgtcgtgtctctggacaatattggcgtcatcgccatggcaaccagggggctttcaaagcgccgtgccaaagcggccagagatctgggcgtctggctgtctatccttcttaagatgatctttgtggggatcatcggatttttgttcaggattccatggcttcacatcaggatactgggaggtgtgatgcttttgtatgtcactttcacgatgatgaaggaaagcggaacgggaagtgaaaagcgtgaacagacagaacagaaggataacttttggtttgccatcatttccattgtggcagtagatgtgagcatgagttttgacaacgtactggctatactcggggtcgtgtctgcggacggcggcggtctgcatatgagagaatttctgctgatcttcggcggtctggcattttgtgtgccgctgcttttgtggttcagcggaaccatcgcagagtggatggaagagtttccagtcttaaatgatatctgctccggataccttgtctacactgcagtcaaaatgatgatggaagatgagttcgtatctcttttccttcaggagattaatttttccatcgcagctccgtgtgcggcattggccggtattcttgtggcctgttttaaagtctattcagaggggagggattttaaatatcacagcggaaagatcatcgtggcctgtgtcacggctctttcctgctatgcagtcatggacatggcagtgctctcttacctgagcaccgggccgtctccgaagggataccagctgagtctggaagccctctacggttttctgccaaaagggatcaacgcggtccatctcacctccatgtcctcgggtgtactggaactgtgcgtggccgtctatacggcagatgtgatgaggcggagggagctgtcctcattcttctggagatacataaaagtagaaaatacgatggcaagacttctgctgtttcagacggccctctatgtcatagggctgacgcttaactttgggctgggaaaaccggatgtgtggatgttcatctccgaactgctctttgaattcctgttgatgagtgtctatgcagcggtctttgggctcctgtgtttttcctttaaaagcgggggattgggactggggatgagccttttgttcctcctgctggaagcggtcatatcctctgtgctgatgctcgacgagaccagcgtgctggcgggaatgttcccgaattattatctggaaaacatggaaagccatatgcacgatatgatctttatcatgcgagggatctttatgtcggcgatctatatattgcctgtgctgatgattggggagagaaaaaataacagacatttcaggtgtttttaaaagagtgaggaattgcagtaataaagttgttatcacggttttgacttgcggaaggtatttcagattatatctcgtatgagtcattgattctccttttcaatccataaacgcagatttccaaatgactatgccgccttttcagaggcagaaaggtgtgctgccgcgtagcgttcacaatgctcttgaaaggtttcccgataaaagctacgttcaaaagagcgatcgacatccaggtaaagtcagaaccgacatcaggaccgacagaaaggtaagggatgctgtcaagcatctgaaaaacttgtttgtatttcataagtttatcctttctggcaggcatccatttccaaaaggtggatacacaacctggcggcttaatccccctctattataaatataaaaaatgcctaccctgtcgaccaaacggggtaagcgtatctagctgcgggggttatcccgccgtaatctccccgcagataagctggaagctttcagttaccattcccaggtagtcttcatcaaccaggacaactaacgtatcgccggagtgtaccacagtgcttcctttggcgataatctcttctttgccccggctgatggtgacgatcaggcagtgttccggccaggccacatctttgattttttttcccacagcaagacaggttgttccggcaacaaagcttgagagcacttttccctctgcggcatccgttgtttttaatcccttctttgcaaggatgcggcccagaagactttcgtagattggctcacttttcagaagatgggcaatcacataggcagtcagtgatacaacggccagggaaagaaaatgttcaaaagtacctgtcatttccgcaatcagaatgacgccggtgatcggggctctgacgatggcagtgaaaaatccggccatagcaaggataataaagttaatgatgtaatcctgactgatgcctgtaagtcctgtgacagaggttccataaatagaaccgatgtatgcgccaagtatcaggagagggaagaagatgcctcccggtgctccggagccaaagctgacagccgaaaacagaaacttgacaaggagcagaagcaccatagttccgatcaaaagatgtccggtctccaggcgttcgatcatggcatggcctcctgcgagtacagaaggaaggcagtagcacagcacacccgatacgaggaacgggattacggtcctgtactccggtttcaggaaggagagttttttgtaaacatcctgtcctttcagcatgacacggttatatatggccccggcagcaccaaggatgatccccagcaggatcagcaggccgtaatatttaagcggaagggccgacttcagcctgaattcaaacaccggagataatccgaatacatttttagaaataaaatccgaggtcagggcaccggcagtgacacagaccagcatggaactgttaaagttcttctgaatttcttccagagcaaacataatgcctgccagaggtgcgttaaaagcagcggccagacccgcgccggaaccgcacacttccatgatcctttcctttgtcttgctctttcgtgtgatctttgcaagccctttggcggccatggcgcccagttggacagaggggccttcacgtccaagagacagaccgccaaggatcgagagtgtgccgcctgtgatctttgtgatcagtacgctgatccagttctggcttatgtatcctgtcatctccccctgtacctgggggataccgcttccggagcacatttcatcccagctgaccagtctgcctacgatcaggccgaggactaccaggacggcaaaccagcctgcgatatagaaggcatttccttttgtaaagtctataatgcggaacaacagagattccgcgtgatttaataaaatacggtagatgacggcaatacagccggcaactatccccaccatgagtccgtcgaatacgatagagacggacagagagtggggattttcaatttttgaagttttcatatgcgacaatcctcctttgtcaagattattttatcacaagatgtgccaaagaaaaaggaatctgcgcatttctcaagtttgcaaaacagggccttatagtttataatacacacgtatattatatagaaatttaagcaacagattggagaacagagtatgccaccgattacaaatgactgggctgagcatctgaaagaagaatacaaaaagccgtattataaaaagctgtatcagacagtgacggctgagtacgcacaaaagaacatctttccgccggcggatgatatttttaacgcgttccacctgacgcctttgagcaaggtaaaggtggtgatcttaggccaggacccataccacaatgtaggacaggcccacgggctgtctttttctgtgaagccgggagtacagacaccgccgtccctggtcaacatttaccaggaactgcacgatgatttgggctgctacataccgaacaacggatatctgaccaaatgggctgagcagggtgtcctgcttttaaatactgttctgaccgtccaggcgcacaaggcgaattcccacaaagatatcggatgggaagagtttacggacgctgcgatccgcatattaaacgagcaggaccgcccgatcgtctatcttctatggggaagaaatgcccagaataaaaaatggatgcttaccaacccgaaacagctggtgcttgaagcccctcacccgagtcctttttctgcgtccagagggtttttcggatgccgtcatttcagcaggaccaacgagtttctgaaagaacacggcattgagccggtggactggcagattgagaatatataggagcgaagcatgaataaaattgtatttttagacattgacggcactttgtactgtgacgggatcggtattccggagtctgctcagagggccgtggctgagctgatagacaaagggtgtaaagtgatgctctgtaccggaagagcttacggcatggtaccggaatcctatatggaactgggttttcacggcatgatcgcggcggcaggagcccatgtgatctgtgaaggcagagagctgtgcaatgatcaggtttccggtgagaacctgcgaaaggtcattgattacggacaaaaacatgggatcgggatcgttttagaaggcgtgaaagggagctattatgacccggaaaatcaggacggtttttatctgaaagtggtggaaaggctgagagagaccacgaccccttatatatatccgctgtcccaggcagaggcagtgaacaaatggacataccatcacatggactttgcgcagaaggaatatgtggaggagatgaccgggggaactatgagcggtatcatacataaagaagtgaattccgtagagtttatcccttcaggggtcaataaagccaccggcatcaggatggtgctggatcattttgggatcggccggaaagacagctatgcatttggagacagcgccaatgacattgagatgttaaattatgtacaatacggggttgccatgggaaatgcagtccctgaactgctggaacaggccgaatacaaaacggagcctgcagaccgggacggcctggcactgggactgaaacgcctggggctgatcgggtaggagctgcctatgaaaaaagttctgaaagcatttgcatcaatccttctgctggtactggtctttatgctgccgaatatggtgtcatcgatccagagccgcatccaccagaaggaacaaaagaagattgtcacagaggtaaaaaagacccacaaagacctgtttgagaccaagtacggttaccagagcctttcaaaagagggcaaaagggtttacagcctcatgtactatgggattttcaacagaaaaaaggagatcgagattgagcaggttactacaaagcggatggaggatattttaaagcagatggaatccgactgccctgaactgttctggttcgattttaccggaaatatcaaatggaagacatcgggaacgaagaaaaacgtcgtgttcctgccccattatatttttacggaaaagcagaccagacagtacgataagaaattgaagaaaaatcttgccgtgtatctttcctatgcagacaaaaaagagacggaatatgagaaggtctatactgtttatgagcatctgaccaggaggatctcctaccgggagggcagcagatataatcaaaacctgatcagcggcatggtcaatgaagagactgtctgtacaggatatgccaagagtcttcagtatatttaccagaagatgggcatcccgtgccggatggtgtacggaagggccaacggacagaatcatgcgtggaatctggtacagatcgaaggaaccgactgttatgtggaccccacctggggaagcaataatcagaagatgtccaaggggtttttcgggatgactgaggaggaacttctgaggggacacactctggatcagggactcaaggtgcccaaatgcagttcaaagaagaacaattattatgtgaggcagaatcattactacaggcagtttgaattggggaagatctataaccagctctgtgaacagaaaaatcaggggcagatcagttttcagatgggcagccggaaagaatatgagaaggcctgccggcagctgatcaccgacagaaagatttttgatctgctgagaagagtgcccggattcggggcaaaaaagatggaagtgacttattatacagaccgccagctatacattatgacaattaatttcaaataagaattatgaggaaaaacatatgaagaaatatgtaaaacgattactggtaatgcttacagcaactgtactggtgacagcagggaccgtgccggcaaaggcggcagagagaggacttgccacaaaggaagacacaaatgcagagaagccgtcgatcaacggagtctgcggaatattgatggatgccaagaccgggaagatcctctatgcaaaaaacattgacaagaaaagctatccggccagcatcaccaagatcctgacgactttggtggcgatagagaacaatgatgatctgtactccacagtcaaattctccagacatgctgtaaacagcattgagcctggaagcactcacatcggcattaagaccggcgaggagattccgctcatcgacgtcctgtacgggatcatgctggaatccgcaaatgaagcctgcaatggtgtcgcggagcatacaagcggcagcatcgaaaaatttgcgggcctgatgaataaaaaagcgaaagaaatcggctgcaaagggtctcattttatgaatcccaacggccttcacaatgataagcattatgtgacggcgagggatatggcgttgatcacgaaagcggctcttcaaaatccgatgttccgcaagatcgcatgttcttctcattattttatgtccggaaccaacaaggagaaaaagggcagagagttatggaatcaccacaagatggtaaaacagacgatgttcttatacaaaggcgtggagggcggaaagaccggttatacgacaagagccggcggtactctcgtaacttttgcaaagcgcggggatacggaactgatctccgtgatcctgcggggaaacggatatgaattgtacagggatacgatcaaactgtttgattatggttttaagaattataaatccgtggcgccttttgcgggattaaactgcgacctttcagagagccgggaaaatccggtcactcagatggcatgtaaactttctccgtaccagcttccgctgggcggcagcttaagtgacttttctgtgctgctgaccaaggaccaggattctgctgagctgaaagtatataccgagaacaataaaatttatgcctcttatggagatgaagatctgggatcaaccaagatcagttattaaaaaattttcaatgccggaaaagccctttataaagatttttccggcattattttaaatccgttcaacacttttgtaaacgatagggctgtcatatcgaaaagttctctttccgtttactttcataatttcagaaacttctaaatattcttctgaaaagcgttcaaataaagtgaatttcagcacaggggaaaacatgctttctgagggtttcagatccctgaaatcaataccggttaaattttcgtaggtaaatgtgtctttttttaattcaccgggagtttcgtatgaagtcagattcctgattttatcattgcagaccgtattttcgtgttcagcaaaagggaattcaattccgttctttttcatcttttcatattgttcagagttttgaaagtgttctggtcagatggcccgcatccagcttcaaggcaagggatatttctttgggcgaacatgtttctttcttgccgacaaaaataagaatgaacagctgtccgtaagttacattgatctctgcaagtttttccgtacaatactgcgtaaattgtttacggagaactgacacataaaaggcaaaagattcggtcattaatgattacctccatatatttgactaagtcaaataatatataataaaaaaactgcccccaaccgttagatttttgatctgacttttgggggccggctcatcaagcaatatgtttttatatatgggattactggggatcttgtctctgcacaagaatatttaatgcctccggaacgatagaaatctttaccgggagtccctcgctcaggatctcaccgtcatagtcaatggcgatctcactgtctgtggatgcctgttcgataaagatctctttcgtctgaaaatactcgatggacgggtgattttggtggctgccctggagccattttactatcagatcaggagtcgttaaaaattcgatctttttgaggatcaagacgtccagatagccgtctgatacagaagccagcggtgcggcggtcgggaaacctcccacactttttgagttggctactaaaaagaccatggtctccgtggtttctgaaaattcgctgctggtgtactttaataccatatttttggaaaactgcttcggcagttctttgatgccttccaggtaatatgccatcttcccgaggactgcttttttgtctttcggaactttataagcaatatcggtgagcaggccgccggccaggacattgataaaatattcatcgttgaccttaccgatatccactttttttgtctggaaattctttatcataccacagaactctttggctgtctgaggcaggttcatataagtggcaaagtcattgacagttcctgcggagatgatagccagggggatattactctggctgaccactagtccgttggacacttcgtttaaggtaccgtcaccacccacagagacaacatagtcgtattctccgggctttaaggctgccgcccggtgctttgcatcatcttttttctttgtataaaaaacatcaatgtgtggagtgatttgttttaagatcaaagtcgacatgatttcctgcagtgtagcttcaacattttgtttccccgaagagggattgatgataaataaggctttcatgagatcctccttgttgtattccattccccgcaattatgtacggaagattattttacttagagtttaccatagaaaggccggggtcgcaatgttcaaaaaagttgacattacaatgagtacctcttgtatttctaaataaactatttattgtgagaatgaaccaaggcgaaaggataaggagagatgagggacgaaaacttctgtaaaaatctttgttcatatgtggagaaggcaaagcagggagatgagacagcgtatgaacatctgaaccggcagcccgggcatcggttcttcctgcctgaaagtgatcctgacctgaaatcataaggtgacatttgatactgacggagggaaagagattcctgaggaacagacggtgaaagacttcatccgtgactttgagagatgctgcggtgagaggaagaccgtgttggatttttagaaaaaaagagatgtcagccgttagcatgaagggctctggaattgtaccagagtcctttttgtgattttaaccactttaataaaaatatgtgcattttgtcttgacaaagagggtttaggtggatataataaacctacagagaacataatcacacttatatgaaagtatgaacacaaaggtgtataaaacaaaaacaggaggatattattttgaaggtttacagacaggaaaagctcaacaaagatctgccggggatcattttgctgagccacggaccgtttgcagtctcactggtagaaactgcacagatgattttcggagacagtgaaaacatcgcagccttttctctggaagcgggagatgatattgacaagtacagagaagattttgcggaaatgattgaagcatttccggagggaagcctgattatggttgacttgttcggcggaacaccgtgcaaccaggtcatgagatacattcaggagacaggaaaggcactggaagttgcggcagggatgaatttacctatgctgatcaatgcagtaatgtccagggaagaactcaaaggaaaagaattcagcatggacactgtggaaaatggaaaaaaaggaatcttcagaatcgatgtggaaggatttcttaatgatgacgatgatgagtaaacaaccataaatataaaaaaggagagagcgtatggcaaagaaattagcagtaagagtggacgatcggttaattcacgggcaggtggtaacgcagtgggtcaatgtctttaaagcgcagcacatcgtggtcatagacaacaatgtggcgaaagacaagatgcagaaaagcgtattaaagttcgcagcgccgccggatatcaaagtcagtattttctctgtggacaaagcagtggaagcatgggagaaaaatcagttcgggacgaaaaatgtgttcgtacttttcagggatgtaaatcagatcgccgaactccaggaaaaaggggtgtcctttgaagagataaccatcggacagatggcgatcatcaatgacagaaagcagatttataaacaggtaggtttgtcagagagtgaggcacagactttaatggatattgaaaagaccggagtgaagttatatttccagatgcagcctacagacaaaaaagagtcgttggagatcatgaagaaaacatttcctgatctgcactaatttatttacataggaggagagaaactatgacgattacaattttacaggctgttctgcttggtttattctgcgggatagcaaaatgctgtgttccttatacagccggcgctttcatgttcaataccgtcatttttaacgcggtggttgtcggagccgtgctcggagacatgccgcaggcgatgattataggagcatcactgcagctgatttacctgggagtcatctcagcgggcggaaatcagccgtcagatccttgtctggccgcttatatagcaattccggttgctatggcttccgggctgaacactacagcagcagttgccttggcagtgccggttggacttctgggagcacagattacaaatctgatctatttaatggccggattttttgcccagaaaggcgatacattcgtagaaaagggcaatgcggcagggatgaccagatggtcggttatatactgtgccatcgcaagaattatctgctttggtgtcccggttgctatcgcgttatatttcggaagcggtgctcttcagggtgtgctggataacatacctgcagcagtgacaaatggcttatctgcaatgggagcctgtcttccggccgttggttttgccatcattgcgaacctgatttcaaaaccaaaatatattccgtttttctttgcaggctttttcctgatccagtatacgaagatcggaaccattcccctgctgatggtgggaggattcctgacattcctttacatcacatttaaatccaacgagttccagggggagacagacgaggatgatgacgacgaagatgaggaagaagaaccggcagagaagctgctgagcaaaaaagatattctgaaatcctgggtgatctggtggttcagcgcagagacctgccacagcttcgagagaatgcaggcaccaagcttttgtacctctttagtgccggcactgaaaaagttctatcccggagaggaaaacaaaccgcgctatattgaggcattaaaaagaaatatgacattctttaacacagaagcacactggggtggaggaccgatcctcggacttaccttagcgctggaagaaaagaagtcacgcaattacgaagcgattccgggagaagttattatgaatctgaaaaccggtttaatgggaccgctggcaggtatcggtgatacgatttcatggtcaaccctgatgtaccttctgatcggtttattccttccgcttgccaagaaaggaaatccattgggcggcatcgggccaattgtactgctgaccgtgatctgctttggaatcggatattttttgacacagaaatgctatactttcggatactcttttgcagaaaatatgctgaagtcaggcttagtcaacaagatcattgcaggagcaagtattttaggactgtttatgatgggagggcttgcctctacctatgtgacagtatccacaccgattaaatttgccacaagcgcatacactacgacactccagtccatttttgactctatcgtaccgggactgcttccgctgatcgttgtgctctgtgtatggggatatctttcaaaagtaaaaagaaattattttgcggccactttgggagttacaatagtctctttagtattgggatgcttgggagttattatttaattgagctgattctttcgattgacgtgtcctcccggagttatgtatactagaaatatagattgaaaacagaaaggcgtgggcaaattgagagaagaaagattcatcatcaaagtagtagaaatgcactataaacagggaatgtcacagctggagatagggaaaaagctgaatgtctcgaggacgaccatctcgaggaccctggctcaggccagaaaagaaggatacgtgcagattaaaatcaattatccggacggggccatgacaagtacagagacaatcctggaagaaaagtttcatttaaaagaggcagtgatcgcctgtgtaaaagatggtgaagaactcagcgaagaaattgccttttatgcgtcagactatatactgagaacgctgaagaaccatatgactctggccctcacaagaggggtgaccctgcagaagacggtggagtgtctggccaaggacgtgagactgaggttcctcaaagtggatgacgtcaacgtagtgccgctgatggcgacgaccaatattccgcccacggcagaaaaagcataccgcctggcctattctaattacctgatcgatgaagtggcaaggatcatcaacggcaacggttatcagctgctggcgccgcagtatgtgacctcctcggaagtaaaagaacattttctgaatgaagacagtgtaaaagaagtcatggatctggccagatccgcagatgtggcagtgatgggaattggaaccatcagccagaattcggctatcatcaatgcagagatcattccggtggaagagtttgatcgaatgcaggaaaagggcggaacaggagagattctctcacatgttgtcaatgagaacggagaactcatcgaagatgattttgaaggaaggctgatcagtttaagcctggatgacctgaagaaaataccgatccgtgtcggcgtcgcttacggcatggagaaaaaggatgcgatcttaagcgtcctgaaaggccggctgatcaatgtgctcatcacagatgacgaagtggcagagtatctggcaaaagtagaattataatcataaaatcccaaagaagcatgttctttgggattttttcttttgatatagaaaggcagaaaaatggagatttgtattaaagaaaagttagaagagaaaacacctcatgcatttgagaagaaagtcctggacagggagatggcaaaaggggagccgagggtcggcatgttctatcagaaaaaccaggttccgtcggaggatctggatctggcccttctgcggacagagatgaaacgggaaggagaggatattaccacaagtgaaatccaggagctctctaagattattaaaataaaagatcatatgatcaatatccatatatacaggggaaaggacaccggaaagaaaaagaatgcggtgctgttcatccatgggggtgcattttttggcggggatgtaaagacaaaaggtaaccagtgccggtatctggcagaacaggcagatgcagtggtgatctcaccggaataccgtctggccccggagactccatttccgggagcggtagatgatgtgatggggactttagactggattacagaacatgcggaaaaactgaagatcgatgaggataagattgcagtcatgggagagagtgcaggcggcactctggctgccaactgctgtcttatggatcaaaaagagagaatcaagctggcggtttatatttatggagcccttgatctgactccggcagagaggacaccgtatcactgggactattctttatatgacatgtatgaggggcagaaggattatattatgaaccgtctgttccgttttaaagaattgacagattacatggaagacctgtatgtgcagaatggatactccacaatggacggggaggtgtctccgctctacgcagaagatttatcgaaaatgcctaagactttgatggttgaggcagaatttgactactttaaaatatgcaatgacgaatttgtaaagcggctcactgaggcggggataaatacggaggtgatcctgtatgagggcctggatcacggattttttgaccggatcggctcacttttccaggcggaagactgtatccgggagatcgccgaaagagtaaaaagattgtagaaaaaggaaatctccaatccgtatccgggcactgtgaatctgggatgattgcagttttaaaataattgtggtaggatttgaagagaaaaataaaataaactggtgtgcccggatgaaatcctgtttgcaggagaaaacagaacggaagactgccggaagcggacatatgcctgagggctgtgtctgcttttggcagtcgttttttatttaaggaggttttaaaatgtatgtaatggttgatcattatgattcctatgtatataatctggtgagggaatttcagattctgggagcagaaataaaaccggtaaggagtgactgcgcagattttgaatctctggagcggctgcacgggcagaagaaacttcaggggctgatcctttctcccggtcccggaagtcccggggactgtgtaaaatccgtggagctggtgaggaggtttacaggcagggttccgatcctcggagtatgtttagggcatcagatcatctgtcatgctttcggctgctgcatcatcaaagggtcaagacctatgcatgggaaactgacgcctgtaaggcacagacaggaggaactgttcacagggcttcctcaggattttcttgtgaccagatatcactctctgaccgcggacaaagcaagccttccagaggcactcaggatagacgctgtctccccggaccgggaggtgatggcggtcagccacaggtcagagccggtctggggtgttcagtttcacccggaagcggtacttacggaatatggactggaactgcttgcaaattatatgaggctgtgtgagaggtggaaagcatgaagacaaaagtaaaaaagcttaatttttataaagagccggaagaggctttttatccgtacaggaacgaaaagtatgccgtgtttcttgactcttccatgaagaatgaacagggcagatattctgtcatcgccctggaaccttatcttattctggaggaggaaaatggagtgtgcaaaataaacgaagacatttccggcgatcctgtcgagaaagttctggatcattatctgaaattatataaagaagaaaatatcacaggactgcctgtggtttccggggcatttgggtatttgtcttacgacttcggaaggaaatttgagaagatcccgtccagacatgcaaagactttaaaaattccggatgctgtgttcgctttttatgaccgtctcatcatagcggaccagaaagagagaaggctttatctggcctcaagagaggaactcaccggcgccgctgaagcttttcaggagatggaagagacactgctgaaaaatgcggccccggaggttttgcaaaaacaggaggggagaacgcagttttttccggatttcaggaaggaagagtatgagagagccgtggaacagatgattacctatattgaagaaggggatatttatattgccaacatgacacagcagctttcaatcccgggaaaaggaaggtgttatgatgtattccgatacctgcgcacctgcaatccgtctccgtttggcgcctatatgaattatggggaattccaggtgatctgtgcatcgccggagcgttttctgaaaatacaagacggcaccgctgtgacgaggccaatcaagggaaccagaagaaggggtgaaaccgaagaggaagatgcaatgctgagaaggcagctttcagagtcggaaaaagacagaagcgaactgctgatgatcgtggatctggaacggaatgacttaaaccgtgtgtgtacgcccggcagtgtccgggtgccggaacattgtgtgccggaggagtatgccaccgtgtttcatttagtcagcaccgtgacagggaaactggaagaccatatgtctgtggacaggctgataaaagccatgtttccggggggatcggtaaccggggctccgaagatccgggcgatggagatcattgaccggctggagcggagcagaaggggactctataccggttccatcggatatttctcgctgaacggggactgtgacttcaatattgtgatccgcacagcagtttataaggacggaagataccatctgggcgtgggcggcggcatcacatgggaatcagacccggagtttgaatacgaggaaatgatgcagaaagcaaaagcggtgctggaagccatcgcggcaggagagaggagacaggaatcatgagattgcagccggatgaaggatattattttggaatcggggcttttgagacaatggctctggaagacggagtcccggtgttttttgatcggcatatggaaaggcttgagggagctgcaaaatatttcggaataccttttcaaagagaaccggtagaaagaatggtgtgggattatctggaccggaacaaagaaaagctttccgggcatgatgccctgaaggctgcggtgtcagagaaaaattttgtggtttcagtgcatccaaacccatatgcgggaaaagattcagatacaatggttcgcacagagtacagccagatccgaagaaacgaaacatcaccgctcacatactataagacactaaactatgcagaaaatctaatggaaaagaggaaggcagcacaacagggatttgacgaagctgtctttctgaacggaaaaggagagatcacagaggggaccgtatccaatgtgttttttgtaaaggacgggaagctttataccccgccggtttcctgcgggatgcttcctggtatcatgagagaatatgtatgccggtcctttcaggcagaagagactgtcatccggccggaggacataaaaatgtacgatgaaatgtttctgaccaattcccttatgggtgttatgactgtggagagtctgggagagcatcagtttcactctgtcaagacggcacagaggctgagacgccggtgcagcccggggcattttcagcctgccctctaggtctcttttctgtcgtaggtgcctttgatccccatctgttcccgatactttgcgacagtccttctggagatagagattcccttctcttttaaaagggtgcagagcttttggtcactgtacggcttcctcgggtcttctgaggcgactagtttttttaagatcgtcttgatatctcctgtgctgatggatgtgccggaggcaggagcagcgccggaaaacagagatctcatggagacgatgccgcacggaaactgaagatatttgcctttgatgccgcggctcaccgtggagacgtgcgtgttgatatccccggcgacgttgttcatggtcataggcttcagacagccatggtttaaaaagaaatcaggctgtcttgcaagaatggcttctgtgatctttaacatggtctgtctgcgatggtcaatgcttgcgatgataaaacggcaccgcttatattttttttgaaaatattctttcagttccgggtcttttgcgtctctgagcatttttacataatagtcgttcagagaataatttcctacccagtcgtcgttcagccggatatcccactggccttcctggtatgtgacgatgatatccggcgtgatatattcggtcctcgccgttgaaaatccctggagcggcttggaattcaggttacggatgacggcaatgttttttcggacttctgccgtactgatctttaatttcctggaaatggtgctgatatggcccagggcaatgtcatccagatgatccagaatgatcgtctccaggatatcggtttttttgcctttcacctccagctgtttgagcagacactgggacagattttcagaaaagattcctacaggttccagatcggagagcacgtcatagcacatcctgatctcatgttccgggatggttaagagaacggaaagttcatgaacagaaatcttaaagaaaccgccggagtccaggcagtcgatcatgaacttcatggtctgccattccatcggtgtaaaatcgttctggttcagctgatccagcaaaaaggttttgacttcctccgtgttttcggccgggatgtcaaaactctggctttcagaaacggtataggaagaggagggcggtgaataatccaggattggattttctatatattcattttgcaggaactcagacagctccccattatccagtgccagtatattcaaagactggatctgtgactgggacagctgctgcttttggttcagttccaggcttgtgcggtaagacgtatccacgaaatcctcctccttttcacgtgctcattttaatatagacatattatatcatatatctttctccatggcacgctccgcaaagcaggagatttcttgggtgtacaggagggtcagccggtgcatggctcttgtgcacgcaatataaagcagatttctgtcgtgttcggttttgtaagttttgctgtctgcatcggggaggatgacttcatcaaattccaggcctttggacatcctgacggaagtgaccgtgatgccgttctgaaaactggtactctcgggagtgagaagatggacttcaaattcttttgtaagcagattaaaaactgcagaggccccggcatttgtttttgtgatgatcccaagagaagaactgcgtccctctataaaatgtctgacagcagttttaagtctgtcaagatggtccgcttcatcggcacaggcatagaaggcaggcggttcaccgcggcgctccaccggctctaaggagtcagtaccaagaatacatttggcaaacgtcatgatttcataagtagagcggtagcttttcttcagttccgtaaactttccagccttataaacagtcctgatatcttccaggctgtgaaggtgatatggatgtacggactgcccgaaatcaccgataatagtttttgaacatggaaataaaagattgatgacagcatactgtatcggagtgtaatcctgcatttcatcgatcaccagatgttttgtgatcctgcttacgtttaatccttcaaaggcagcgctcaggtacagaaaaggatatacatcaggccattccagagtgctttttgctggcagcaccagcatttccggtactcccgcttttctgtaaaaatctttgtatagtgcaagagtacttttcacagaaagcatggaagtcagctttttcaatatttgactggcccttggcagatcttcctgcatggtattttcggaatgaaaacggttacagatatcgtctgccgtcatttgcagacgctgcttaacagggtgttttctgtatgcgtcaaaccgtttcgtgatccattctttttccgccttaaaatggccaaaggatacatcgtcaggaacaaagatctgatggggcatttcttctatataattatccatgagacgaacaaaatccagtgatgatttaaaacggactctttgtatataagacgcatcgcttaattccaggggatctttttctgattcaaaatcaacggaatgttccagctggattccggcaagttcaaaaaaactcaattcatagatgggttcctcaccgagttcggggatgacatttgaaatataatctccaaacactttatttggggaaaggattgtcacatttttggaactcagccgatctttcaaacggtagaggagaaatgcgatgcggtgcagtgcaatggaagtttttcctgaaccggcggccccctggatgatcaatgtttcagtttcttcatcccgtatgatccggttttgttccttttgaatcgtagaaatgatcgttttcatcttttcactggaagtatggctcagctctttttgaaggacatcgtcctgtatatttgcagaagtctcaagggcatattcaaggactccgtttttgatgccaaactgccgtttctttgcaaggtacccctcgatcctgcccgacggcgcatcaaatccggccggcccgatctcgtaatcgtagaacataccggatatgggtgcccgccagtcaaggatcaaaagttcatatccatgccggaaagaaaaacgcccgatataatatgtttccggccttaggctgccttttttgcaaaaatcgattcgggcaaaataaggagaatccttcaatttgcagagcctttcatacatttctgctgcaaatgcgcctgtgtggtctgtctgttttaatagcagctcattttgaaacatttcatggggatcgatttctccccgggcctcggacatataatgtctggcatctgtgtactgccggtccagccggcttacagcttcctccgcctcgcggagtgcctcgtcaagcctggtccggatcaatgtaaggtgctcccattcatccgggaactgtaattctttattttccatgatcctgctcctccctgctcagaataaacctttgtgtgggatagccgaactcaatgagaagttctgcctctgcaaatcccaggtcctggatttctctgcggtgccctgtgtctgccctgtctccttctctgaatgtggtaatactgatttcttttccgttcagcaattctgtcatgactttctcaagaaaggcttttggtatgcccttttttctatacagaggatgtacacccatgaaatcaatggcaccggtttggtacgaaaagagcatgatacccacagcgcagtttccgtcttttaagatcaatgcctgctttgttctgatcttttggcgcagaattgcttcatattcatcctcatgcaggtggggaaacccgtcaatgacaaggcgtaccagttccatccagcaagggatgtcatcttctgccgcgaatgtcacattccagttcgaagcttctttgctgtttaacataggatagttacctccaaaatcaaatttaagctgaaggggatagaatttttcattttctctgtattttcctggagatgtcttatacattgccgtaaaaatatttgaaaaggcctgctggctttcataccctgacttcagagcgatatcaagaatcggctgttctgaaaaaacaagcagtttagcggcttcagtcagacgccggcgctgaatataatcgtgcagagtcaggcccacagcagcagtgaacatccggtgcaggtggtattttgaatagtgcattgctccggagatgatttccaggtccagtttttcggacagatgagattcaatatagtcaatgaccgatacgatcttttctatttttgtgtaatgcattttttgattctcctttcactggaattgattataactgcacaggacagaagggttttcatcattcttgcggttttcctgaataacaaagaaaacaggcttatcgttggcttattcattcatgatgggtatacaaagtgatcaagcccctttactttttcttctgggagagtaaaggggcttatttatggaaagagacaaactattccgttatccatttggtaatacagctgatgtcatttctcggccggggatcaggggattcatctgcatatccgactgccagcgcggcaaagagctgtccttgcgcgtgaagccatgttgtcagttcttcaagggcaaagaaaatatcacagatccagaggcttcccaatcccagttgacaggcggtaagagtcatattctggatcgcagccccgatcgactgggcgttgcagagctcagagatacggtcttcttctgtcagagagcgcgacaggtcaaggcctaaagcattggtgatgaatatagtaaccggagcctgcctcatgatttcaagcgtacagcgcgcgccgttcagatgagcgctgctgtacggcagaaggggattcacttcttctcttatgataccctgttccatagccgagagcatcccggcttttgcagtgcctgagacgacggtaaaccgccatggctgcctgttttttgaggacggggccagaattccggcctgaaggatctcctctataatcatgggagatacatcagtttttttaaatttccggatactgcgccgctttaaaatggcgtctatcataatataacctcctgaaagcataaactaatttatcaacatattcctgagaaacaaaaaaagttccgttaaaacggaacttttaaacataggcctggcgggaatcgaacccacaacggccccttaggagggggctgttatatccatttaactacagacccgtgaaacacatctattattgtaacgattcatttatgaaaagtcaatgaaaaaagttgcatggcgttgactttttcatattttttcattaaagtagttaaatagaatctttctacgctcggccggaaatatgcagggaggtagtttatgaaagcgatcaatgattttgtatggggacctgtcatgcttgtgctcttgatggggacaggtatctttctgaccatacgccttaaatttcttccgtggaggaatctcccctatgccttaaggatggtgtttgtcagggataagagcgggggacaggacggggatatctccggattccagtcattgatgacagctctggcagctaccataggaaccggaaatatcgtcggcgtcagcaccgccatggtcatgggcggccccggggcatttctgtggatgtggatcagtgccctgttcgggctttctacgaaatatgcagagagtgttctggcggtgaagtaccgggaagtcaataaaaacggagaaatgtgcggcggacctatgtatgccatgaagaatggttttaagattaaatggatcggtctcgtgctggcatttttcttttccttatttacagtatttgcatccttcggcatcgggaatatgacacaggccaattccattgccgagtcaatggcaggcctttggggcactccccactggctgaccggagctgtgatcgctctgctggcattgtccatcctgatcggagggatcaagagcatcggcagggtgtgcggatttttcgtacccaagatggcagtattttattttgtgatgggcattgctgtcatctatatgaacagggccaatctaggacagggaatcaggatgatttttgaaatgggactctctccgagggctatggcagggggagtcggaggtacgattgtagcaggattattttcttccatgaggtggggaatcgccagaggaatattttccaacgaggcaggtctgggttctgctccgatcgttgcggcagcggctaagacggatcatccctccagacagggatatatcaacatgacagggactttctttgacacgctggtcgtatgcagtgtgacgggtctgattgtagcatcctcgggggtgctcggaagtgtggattcccacggcagactgatcaccggggcggcgctgacgatgaaagcgtttgaaaaggctcttggcccggccggggagatatgcgtcggtctggggatcatcatgtttgccttttccacgatcataggatgggagtattacggagagaaagcgctggaatacctggtgaaaaagacttcttatattaaattataccgggttgtatactcttttgtagtctttgtgggggccaccgtgccgcttcagcttgtatggaatttctcggacacaatgaatgggctgatggcagtaccaaacctgatatgcctgcttgttttacataaagtagtagtaaaagaatgttttcgttttgaacagattaagaaaggacgatgaatttatgaataaggtatttgtgtttttagcagatggttttgaagagatagaaggactcacggtcgtagatatgctccgtcgggcagggatcgaagtcattatggtttctgtagggccttctaagatgatcacaggctcccatcatatcgaagtggaggcagactgtatgtttcacgaagtgctggagccggaaggagccatgtatgtgctgccgggcggaatgccgggcaccattgcgctgagagagcatgaagggcttgcgaagcttctgaaaaaggcgtatgataatggaaaatatctggcagcgatctgcgccgcgccgacagtgctcggcaagtatggatttttagacggaaagaaagcgacctgttatcccggacaggaggatgggcttggaaatgcggaatatgtgactgaatccgttgtcgctgacggcaaggtgatcaccagccggggtatgggaactgccatcccgtttgcggggaaattggtggaacttctgcttggaacagaggccaaagagaaattattggaaagcatcatatacgaggaaaaataagaatgcaaagtacagaaaaaataagcatttgggagcagttctacattgcctgcaccaaaccgaggcagtataagaagctgctgaacgtgaaaaaatggaaggtagctatatttacattgctgataggcctggtcattactctgcttggaccggtgatggatctggcaggatttgctgtgagtgtgggaggcccgagaaactttgtcatgaaccggctgcctgcctttgaactgagagacgggcaattaaagctggaacgcgctattgactttaatctgggcgcactccatatctcggcagattcaaataaaaagtccattggggcagatgacttcgatgataaatattccgatgaagttcatttttcaaagaataatatggtgattaagacttctgtcatgggacagaccataacaaagaatttcagtaccatgaaaaatgtcacatttacgaatcaggatatggcgaatctgcttccattggtatatttcctgatatttgtctcactgctttttgtatatgcaggaatcgtccttcagtatctgttttactgtctgctgatctcctggctggtgtctctgaatatgaaaaccagaaatcagcccatggcattcgggaagatttttcagatgtctatctatgccagggtaccctgtgaactgatcggtaccatcggccttacggcggggatttctttcttcacagggatcatatggatcatgatcggatatctggtgagctatcagctgatgatgatgggacttgtggagaagaaggcgaaagagtagaatctgaataataatgcgtctggaaatcccttatgaagaagccgaagcagatacgtccagcacaaagccggaagaaaaaatacgctttaaaaaagtaaaggtaataaggttcgcctgaagccgatccttgagaagatgtcccagaggatgtgcctgtcagagcatccgtttggaacgataagatacgagaaaacccctgagaacatcctcaggggtttttcagcaaaattagtcttttatataaacgggggagaggaccccggttatattatttatattaatggtcgcttttcagtgggaaatctgcataaccggaaataccatgctctgatatgtccatacctgcaatttcttcttcctcggaagcgcgaagtccgatggtatgcttaagtccctggaagatgatgagcccgccgacaatacagtaagcggcaacggcagcgacaccgataaactgtgctttgataaatgcacctcttgtgatatctaaaagctttaatgaatctccggttgcgaagaaggctgtcagaagggttccaaccacgccgcaggccagatgcacaccgcaggctccgaccgggtcatctatttttgcttttttatcaagcagttcgattacagcaactacaacgactccgcagatagcaccgatggcaatcgctccgtaattggataccacgtcacaaccggccgtgatacctacgagtccagcgagggaaccattcagagtcatggaaacatcaggctttccatagcgtacccaggtgatgatcaatgccactaaggtggatgcggcggcagccaggtttgttgtcatggcgatggagccaagagtatcggtggcagcagtcgtggaaccgcagttaaatccgaaccagcagaaccataagataaagactccaagtgcacctaaagcaatgttgtgggcaggtatcgctctcggagttccgtctgctttatatttcccgatacggggaccgagggttgcagcaccgaccagtgcaagccatccgccgacagaatggactgcagtggagcctgcaaaatcatggaaaccaagatcggcaagccatccgccgccccagatccagtgtccggtgatcgggtagatgatcagactgatcagtgcactgtaagccagataggaagaaaactttgtacgctctgccatggccccggaaacgatggttgcggctgtggcacaaaatacagtctgaaagatcatgaagacacccggcgtgagatctttaaactgctgcaagtcaatggatgttggattgaaaaagcctgtggtgccgacgataggattgtcgcctccgaacatcagggcaaatccaatgacaaagaaacaaagggtgccgaggacaaagtccatcaagtttttcatgatgatgttgctagaatttttcgctcttgtaaaacctgtctcaaccattgcgaagcctgcctgcatgaagaagacaaggaaagctgagatacaagtccatacaatatttaataactgctgtacgtccatatttatatcctcctttaagacaaaaaggggacaatgcgtgcctgccatttatggcctggctgcattatcccctttgataatgatgtaagtattctattgttttcatatttttaccgcttagattataaagcgtcttttccggtctcaccggtacggattctgatagcttcttccacaggtgagacaaagatcttgccgtctccgaatttaccggtgcggacggtgtttacgatatctttcgtcaccttttctacaacttcttccggcatcacagattctactttgatcttagggagcagattggaattcaattcattccctctgtatttctgggtaaatcctttctggtttccatagcccatgatattggagatcatgagtccggatactttgtgagcttccaggatatgttttacatccgtgagcttctcaggtttgatgacaactacaactttcttcatcataatataattcctcctctttttaatttaagaaaaaaaggcattccaatctcttgatcggaacgcctttgttcttgattggttcccattatactcctggggattcatttgtcaataaaaaatcggtttgtataaaaataaatacagatgaaaatcattcttaatctgtctgtaaaacatgatagaatagaagaacaatcaggagcggaggaatttatggaaaaaaagaacaaatcattgatggtagccctcgcggtgcttgccacttttttatggggaagcgcttttcccagcgtaaaattgggctatgagatctttaagatacagggagatgatatcgggagcaagctgctgtttgcaggcatccgttttgcggcggcagggctcatggtgcttgcagtcttaggagtccagacaagacagcggccattgccaaaaaaaggggcattcaaacagcttctgaccctcggaatccttcagacgacaatccagtattatttcttttatgtgggccttgcgcataccacgggagccaaggggtcgatcatcaactcatttacggcattctttccggtggttttggcacctttcttttttaagagcgaccggctgacggcaaagaaaatcataggatgtgccgtggggctttccggcatcgtcctgatcaatctccagggagggagtctcggcggatttgcctggaacggagaagggttcattgtgctggcggcactgtcacagagtctcgcatccatttacagcaagaagctggcacagacgatgaatgtgatgctgatcgccggatatcagcttctgctcggaggaagcctgcttctgatctttggatatgcaggaaatggaacgttgacgttccaaagcagcggcctgcttctgctgctttatatggcagtcctctctgccgttgcattcagcgtctggacctggcttttatttcattatcaggtcagctccatttccatctataatctgctgatcccggtgttcggaaccctgctttccggcctgcttttaagagaaaacgtctttaccgcggtaaatatcgcatccattttccttgtatgcggaggaattgcggcagtgaataaacagtagacagcctgttttgtggaatattcatacgtctttttcattgtagcggtttctgcgatgaagtatattagaatagtaaaggaatattacatatttgcggaaggaacatgctcgaaaaacagaatgagatacagacattgaaagtaggaagcttcaaggctgccataaaggcgaaatgtccgatcgtcccggtagccctcgtggatgcatttattccttttgattccaatacgataaagcctgtcacagtccaggtgcattttttgaagcccctgtattatggtgattacaaaaatatgaaggctacggagattgcagaacaggtaaaggacagaatccaaaaggcaatcggattacattaaaaaatattgtttttagacagaaaaaaaggccagatagggaaatctggtctttttgaggggagtataaataaattaataaggggttatatagtagaaatatatataatgaataccttctactatctgcattataaggtatcactaaaaaaaaagcaataaatttttttcagatgaaaatatggataatacaaaaattttttataattgcgttttgtaaatcttgcaagaatatttttttctcttttgcagacaatatttgtgtaaccaacagaaaggagaatttatcatgtcaaaaaattattctaacgaaagcaacaacagtaacaacagcaacagttcaaacgagagtaacagccagaacagatctcagaacaaatctcagaacaaaaaccagaacaaatctcagaacagcagccagaactcttctaaccgttagttattagaagaagaaagcgggagagacgtccaaagaaactttctttggacgtcttttcatgttcctgcatattctaaattataaaaggaaagtgtttgaaaatggaatttacaaatataactttgcaggaaggtattgaccgttcgaaacaggatgatcatgtgatgtttgatgtgagagaaccgtatagatttaaacagggacatctccaaggggctctcagcatgccctatggtgtcataaaagatcaggatgctttcagagataaaaagatcattgtttactgtgacttcggcggacagagcatgctggctgcaaggcatctggctgagcagggatatgaggtctacaatattgtcggcgggatttattattaccgcggagagttgacatctctgggcctaaaattgtagaatgaatattataatgcaaaggagaaacatgaataatatagaattgatcgccccatgccactttggcctggaggcagtattaaagagagaaatacaggatttaggatacgagattgcaaaggttgaggacggaagggtgaccttcttttctgaccttggcggaattgcaagggcaaatatgtttttgaggaccgcagaacggattttgctcaaggttggtgcctttcgcgcatcgaccttcgagcagctgtttgacaggacggcagagcttgcctgggaagattttattcctgaggacggaaagttctgggtgaaaaaggcttccactgcaaagagcaaactttacagtgctccggatattcagtcgatcgtcaaaaaagctatggtagaacgtctgaaaaagcggtaccgcgtgtcctggtttccggaaacagggaacgagtatccagtgcgtgtcttcatattaaaagacgaggtaacagtcagtcttgacaccagcgggactccgctgcataagcggggctaccgcactctgacaagtgaagctccgatcagagagactcttgcagcggcgctgatcatgctgacaccctggaagaaggaccgcatcttggtggacccgttctgcggaagcggaacctttctgatcgaggctgccatgatgggagccggcatcgctccggggatgaaccgctcctttgaggcagaggcgtggactaattttcttccgaaaaagacatggtatgatgcggccgatgaagccggagacctgatggacctggatatttccatggacctgcagggctacgacaaggactccagggtactgaagcttgccagggaaaatgcggctgccgctgaagtggatcatctgatccatttccagcaaagagaagtaaaagatttcagccacccgaaaccctatggatttatcataaccaatccgccctatggtgagcggcttgaagaaaaagaggctctgccggaactttacgggcagattggagacatttttcagaagatggatacatggtctaaatatgtgatcacctcttacgaagatgcacagaagtacattggtaaagctgcaaaggttagaaaggtctacaacggaatgattcgtgccgagttctgtcagtatctcggaccaaaaccgcccaggagataagattatgaagaaaagaattatatttgcaacaggaaatcagggcaagatgaaagagatcagggaaatccttgcggacacagagtatgaggtcgtgtccatgaaagaggcaggggtggacgcagagattatagaagacggcacaacatttgaggaaaatgcagtcatcaaggccaaggccatcatggaacttaccggagaacttacgatggcggatgactccgggctggagattgatgcgctgaacaaagagccgggagtgtactcggccagatatatgggagaggacaccccgtatcccgttaagaatcagaagattctggaccggatggcaggcgtgccggaaaaagaaagaaccgccagatttgtctgtgtgatcgcagccgcatttccggatggacaaatacggacaagtcgtggtactatggaaggtatcattggatatgagataaagggagagaatggatttggctatgatccgatcttttttctgccggagttgggcagatacagtgcggaactttgcagtgaagaaaaaaacaggttaagtcatcgcggagaagcattgaggaaaatcaaagacattctttagggaggttatcttgtgagaattttagtaatcagtgactctcatggtcgtaatgacgatgtaaaaggggtattggagcaggtcggcgagatcgacatgctgattcactgcggcgatgtagagcgcggtgaccagtatatccgtgatattgccggatgccctgtcgtcatggtagcgggaaataatgactattatcttgacctccccagcgaggagaccatagaggtagagggctaccgcatctgggtaacccacggacatccgtattatgtgaattccggggtggattatctgcgggaatatggagagatgcacgatgtagacgtcgtgatgtacgggcacacccatgtgccgttcatagagatcggggacgatatgacaattctgaaccccgggagtatttcctatccaagacaggccggcagaaagccgacgtttctcctgatggagatcgacgatatgggagaggctcattatgcccatggatattataaagaacatttcagagaactgaacatttaacatgaaaaaactgtttgtggcatgaatactgtaagtaacagcgaggctgtccaagtgtcaatggcacaggcagttttttcgtcgtataaagaaaaataaattagagttgaggtcaaagattgaaaatgagaagtagagggtatccatttatttaatcgcataacaaataagccatcttctggtggctactttaaaaagtgaatattgaaaagttaaggttatgcagttgctgacttgatcttataaccttgattccttgctatgatgatggcctgttctaccgtgatttcacggtcaacagggggcacttctgattttcggtaaagttccgcattatagttttcaccgttcttcagcatgtgatataatgcagtaagaagcattcttgccacggcaatgattgctttcttgtgaccgcgacgctttttgatacggagataacggttacgaaactcaggatgcttattacttttaatcacagcgttagcacactgtactaaaagaggtttgatatagcatccggccttggaaacccggacagattttttcttccctgcactttcattgttggttggagcaagaccagtccatgagcacagatgtttcgccgaagggaaagcctccatgttggtaccaatctcggaaatgattccgatggcagtgaagtcactgcggataccaggagcggtttggagaatggcaagttcctgctgatagggagcggcgagcgcaagaatgagttcttcaagctctgctttccgggattccaggttttcataatgcgctttgatcaccttaagtttaccagcctgttccggagtgatatagccgtcaatggcatcccggagttcaggaagtttctttttcaaacttttgtaaacgagaggttcaaggtcaaaagaagtatctgcgggattttccaaaagtttatccagtatcgcctgagcagatttgccgaaggtgtccgaaacaacgtttcccaactggatattggaaaccgtgagacagttctgcaaacgattcttttcgcttgatttgaagcaggtcagtttgaaacggtaacgcataaggtcgcggagctgacggatgtcagcgggtggcataaagcttccggtaacaaggtcatgcttaaacaggtcagcaatccatttggcatctttcttgtcagttttctttccacggatagccttaacatatttgggatgggcaaggacaatcatacagtcgttttctaaaacgttgtaaacagggatccaatatttaccggtggattccatacagacatccttgcagttatgtttgagaagccattgtaacaaatttttcagacctctcgtgtaggttgaaaaacgatggctctcataagtggtgacgcctttaccatcggtagaggcgatgcaggccactacaaaatttttgtggacatcaataccacagcagattttgtacacgatttttaaagccatagggactcctttcagaaccaaaaggttcactgaagattatagggagagacggcattgactgaacgcctaagccataaacgagattgtttatacaaagataagattacgtgctcgaagtcacacttatttgtgcttgaaaaggcggactacacatataaaaatacggtcatccggagagccggacagcccactcacctcctcgtgatttgtagtataccgagttccctacaaagaagaattataaagaaaaaataagctcagggaaatattttcataacgttttgtgcctgagcgaagcgaaaggaatggatataaagatgaaaaagaaggattttgtagaaggcttgattgaaaagacagagtttccgaataaagggacatttgcatttgaggaccgggagatcacagtcaaaggggtcatccagggccaaagaatcgcaggacaggtgaccaagcttcggaaagacaaagctgtcgccagactggtagaagtgctggagccgtctgagatggaggatggtatcccaaggtgtcctcatttcgggacctgcgggggctgtttttatcagacggtttcctatgaaaaccagctgagaatcaaagagggtcaggtacgggagcttttaaaggattatatccccgatgaaaaatgggagggaatcaaaggaagccctaaatggtgggaataccgcaacaagatggagttttcctttggagatgaagtcaaagaaggcccgctggctctgggcatgcataagaagaatacattccacgatattgtcaacattacggactgcaaaattgtggataatgattataatctgatcgtctcctgtgcattaaattatttttcacgattaggctgtgatttttatcataaaatgagccacgagggatatctaaggcacttggttatccgccgttccgaggcaaatggggacctgctaatcaatatcgtcacaacttcccaggctgatgtggatatgaagcctctggcagaggagatgctctctctgccccttcacggcagcatccgggggattctgcatacgatgaacaacagtctggccgatgtggtgcaggcagaccggatagagacaatttacggggaggactttttctatgaggaaatccttgggctgaaatttaagatttctccgttttctttcttccagactaatactttgggggcggaagtgttgtatgagactgccagggagtatgtaggagagacgaaggacaaggtcatctttgacttgtacagcggaaccgggaccattgcccagatgctggcgccggtggcaaagaaggtggtcggtgtggagatcgtcgaagaagccgtggaggctgccagggaaaatgccggtttcaatgggcttgataactgtgaatttatcgcaggggatgtgctgaaggtgatcgatgagctggaagacaagccggactttattgtgctggacccgccccgggatgggatacatccgaaagcaattcagaagatcattgactttggggtggagaagatggtttatatcagctgtaagcctacgagcttggcgagggatctggaaatctttcgggaggccgggtatgaagttgagagagggggatgtgtggatatgtttccttcgacggtgcatgtggagacggtggtactgctttcccacaaaaagccagatagtcatatcaacgtaaaagtagagtttggcgagggtgaggacaaggttccgctaaaggcgatttctgaaagagcagaagcctacaagccgaaagagcgagttacttacaagatgatacaggagtacatagaagcgaaatatggcttcaaagtacataccgcatatattgcagaggtaaagaggaaattaggtttgccgatgtacgatgctccaaatgcggtagaggaattgaaacagccgaggaagcatccaacaccagaaaaagtagaagcaatcaaagatgccttgaagcattttgaggttatataatatgtatttttgaggttagaaacatgagtatagataatgtgatatcaatagttattagtatattgggttcttctttgattacattaattttatctaccttcatttttcagccgatgcaggaaaaaaagagagtgtatgaatcaataattgtatttgcacaaattgtactttttcctgctgaagccaagctttctttaggagttgccagatataacaagaattatctgatgatgaaaatagaaataatgcaataaatgatttaaaaatggcaattcctaagctgaagctgatttccaaggatgacggtttgacgaaagaagtagaaaaatttatccaacaacaaaatgaagaacaatttaatgtgttggtaatgcgactgagaaaggatttatataaataaaatttgaacttgttagacaaaggcggttttggtgttagagtaacgatgaaaaattgcattgggagaaatataatgacaaaaaagaaaaatgagatagctatccatagctcggcagcagaatatctgacgtatgtcgcgtctatcggagataatgcgcatagcatggaaatgcgctatgaggatgagaatatatggctgacgcagagaatgatggcacagctttatgacgtaagtttgccgacaataaatgagcatattaagaaaatatatgatgatagtgagcttgttgaggaagcaactattcggaaattccgaatagttcaaacggaaggaacaagacaggtaaaccgtgaagttatccattataatttgcagatgattatcgcagtcggttttaaggtaaacaatgagcgtgcagtgcgtttccgtaagtggtcaggacaaattgttaaagattataccatccagggctggacaatggataaagaacgtctaaaaaaaggtcatatgttcacagatgagtattttgagcggcagttagagaacattcgtgagataaggctttcagagcgtaaattttaccaaaagattactgacctatatgctactgcttttgattatgataaggatgcggggactaccagacgttttttccggaccgtacaaaataaaatgcattgggctgttcatagacatacggcagcagaacttattgttgaacgggctaatgcggagaaggaacacatgggattatctacatgggaagcagctccaaatggaaaaattgtaaaagctgatgtgtcaatcgcaaagaattatttaaatgacaaagaaatatcctatatggaaaggattgtatctttatatcttgattatgcagaattgcaggcagaacgtcatattccgatgagtatggaagattgggcaaagcggttagatggttttctggaatttaacggaaacgagatacttacaggtgcaggtaagattagtgcagagcaggcaaaactccatgcagaaacagaatttgaaaaatatcgtattgtacaagacagactatttatgtctgattacgataagtttttgatggaattagaagaaaaaggaaaacagaatttataaagtaggaaacagcagaagataataaatggtgtaaaaatgagtattaaatatattttttgtgggaaaagggatgcacaatcagtgttagtactgtataagtattgtccatatttccgtgattttgtggggatatgttttaatttgatactcatgtggagacttgtgtgttgctacaacgaaaaactatgtagagatccttaattttaggcactttttcaagcatatcgtgtttacaagtgagggtgataaaatccgaaataaagagattaaaaactatatcaatgtttcagtagtagttgatatagagtgtgggaacacaacaaattaaatattgaatttgaggggtacttgtaaaaaagtatccctttttatgtatgacgggcatgtccgtgttctgtggtgcaagtccacataggcgtagctaccgacgaacttgtaagcgactcccaaggtttgcatcgtgaggtgtgggcgagaagaagggatagcgaaatcgtagccctacggacagaaacccgatattaaggcgtacatggtgggtaagttgacttaaagcaacgaagccctaaaggtagccgtaacccatgtgcgtaaatcgggagggtagacgaggaaagaacacggacttatcccgtgaggtctcacaggcggtttcatcagccgtagtaacaacgaactgtgagaagtcagcagaagccatagtaggagaaatctgaagggctgaacaatgtaaccgtgcagacgaatgtatgtacctgtgagtattcgacaagcggatgtaggcgaaacgtatatgagctgtaaacgcataaacataggacaaatcacagggagcggaaaggagcgaagcacacaaagtatgtcggaattgttggaaaagatactggagaaaaagaacatgaacgaagcatataagaaagtctgtgccaataagggtgcaggcggcgttgacggcatggaactggaagaacttgatggatttatccgtaagaactggaacagtatcagggagcaaatcagaggaaggagttacaaacctcaacccgtgaggcgtgtagaaatcccgaagcctaacggaagcaaaagaaaacttggaataccgacagtcatggacagggtaatccagcagggtatagcacagataatcagccctatgtgcgagccgctgttttcagaccacagttacggattccgtccaaacaggagctgtgaaatggctatcaaagatatgctcatgttcctcaatgagggatatgagtggatagtggacatagacctagagaaattcttcgataacgtaccgcaggataagttgatgagccttgtccacaacatcataaatgacggagatacggaatcgctgatacggaaatatctgaaagcaggagtcatggtgcagggcaggtatgagaaaacagaacagggaacgccgcagggtggcaatctgtcgccgctattgtctaatatcatgctgaatgaactggataaagagttggaaagacgtggattgggcttcgtgaggtacgctgacgactgtgtaatagcagtcagaagcgaagcaagtgccaaacgtgttatgtattcgataacggactggatagagaggaagcttggtctgaaagtaaatgcagataaaacacacataacaagaccaatgaacctcaaatatctcggctttggattctggaaagattccaagacgaaagaatggaagtgcagaccacacaaggattctgtgcagaaatttaagaggacgttaaagaagctgacagaaagaagaaaatcaatggcgtttgcggaaagggtaaaacagctcaacagggtaatccgaggttggataaattactttgcaataggtaggatgaaaacagcaatgaccgacatagacgcacatttgcgtacaagactgcgagtaataatctggaaacaatggaaagtaccgaagaaacggcagtggggattgcagaagctgggtataggaaaagaccttgcaagacagacatcatacatgggagaccactatcaatggatagtaacgaaaacctgtgtagtcagggcaatctcaaaagaaaagctgaaacaggcagggcttgtgagttgctacgattattacatggaacgtcatgctttgaagttatgttgaaccgccgtatgccgaacggcatgtacggtggtgtgagaggggagatttaatctcccctactcgattgtatggcgttcagaaatgagcgtctatttttttacccaaatgaaaggagaactaaaaattatgaaaaagatattgaaacgattatgtacgggcttcttagctcttgcaactgtcgttaccactttgccgagtacacccgttcatgcgtcggaaaagcaatactggacggagtctgccgagcgtgttgatatcgtagagcgtgtcaataatgacggctctattacagaaacctttaacgagggacacatgaaagtcgaggacgaggacgcttattgtatcgacatcaacaggctttcaaaaacggttataaaatacgttctaatgcaagcgaccgcatgagtgctgaccagattgccgacgttgcgttatccattgaatatgtaaaacagtatgcaaaaaaccacacagggcttagtagcaagcacgcctaccttttaagacagttagttgtctggcagagattaagtgttcatttaggctggaattgtgataatgtgcgagcttcttatgatgaaatgctgttgacttcctgcttgcaataagatataatatgactataaaatcaaattagtcataatggaggtatgaggtatgtataaagaagttagcatatcttcaaataatgttccgataaccctttctatctggtatacagaaagaggtagtcctaccattgtttttttgccgggtactatgtcgcaccctctcatgtatgagaattttctatgtggactgggtgcaagaggatttaatataataggtgttcattatctttcacacgggaaaagccctaaaatcaaacaaaattatacaatggaagatttgctgtataatgtatatgacgcaacaacttacggaatagaaaatttcggagctaacatagccgtcatgggttccagtcaaggcgggattttagcagcaatggcggcgggtagggatacaagattaaaagccgtttttccacataatatcatgctgactacactaaaagaaactatgagcttaacaaagtatcctgcatggacacaccgttttatggggctgatacagtggggctttcgtgtgggcggaaagttgttgcctaactacaaggttccgggagacgcttatttagactatgacaaagtattttatagcgaacaggcaaaacaagattgcttaaacgaccctatgcttttaccatattatcctttaagatttgtcgccagtttatttaatgctgacttatcgtgcttggagaacggctcaatacaatgtccagttattttaattacagccaaaggcgacccgctttttagctttgattataccaacaaagtatttgatttaatccatgcgccgcaaaaggaattacttactttagaacttaatcgtcacatgatttttaatgaggatacggacacgacgataaacgcattggaacctacattgcataaatatctaggatagcatattgataatatgagcagcaaatgctatacttttcatgatgatactaatgatttagtcataaggaggttatgagaattgccacgatttacagaacaagagaaagagatcattagcagtaaacttttgatagaaggagaaaagctgtttgcattacacggtttgaaaaaagtaacggttgatgatttagtagccgctgtaaacatatcaaaggggtctttctattctttttatcccagtaaagaacacctatatgttgaaatcaattttcgcttacaaaaagagttatttacaagtatagaaacaaccattaaaaagaaaaagtataagaaccatagagatttagcaaaggacgttattatgctaagtttaacgggggtgattacttcgcctattctttcacagattgatttatctttaatggactatctgcaaagaaaaatatcgtcagatatttttgaaaatcatatgtacagtgatattcgtatattggagatactggaagatttaggggttatatttttggttccgcatacagttatcataaaatctctgtattctgttttatcctgtttggaacaattcaaagaggacgaagaactgaatatgatacaaaatcttttagtgaatggtattattcagcaagtagtagcagagtaacaattttgtttggttatttgacaggcaggtagccaaacaaattttttacagtatatatgactatatatctgtaaacgtcataaagttaaaggaggaaagaataatgattgatgtaaaaaaactgtattttagctatactgacaaaccgtttgttgagaatgtaagtttccatgttgggaggggagaaattttcggctttttaggaccctctggagccggaaagtcaaccatacaaaaagtattgactgggcttaacacaaaatataaaggcagtgtaaaagtttcaggtattgaaataaaggaacgcacaaatcggttttatgaaaatattggagtagactttgaattttcaacctgctatgagaaattcacagcacgacaaaatctcgcctattttgcttctctatatgaaaagcaacctcggtctattgatgaattattgcatatggtaggcttggaaaatgacggggacaaaaaagttgctgacttttccaaaggtatgcgttctcgcttgaatttcattaaagcgttagtccatgaccctgatatattattccttgatgaacctacaagcggtcttgaccctacaaataatcgtttaatgaaagacattattcttgcggaaaagaaacgcggaaaaacgattatcattactactcacaatatgtttgacgcaacagagctatgtgaccaagtagcctttatcgttgccggaaaagtcagtgcattggatagcccgcataatttgattatgtcaaggggagctgccaaaatacaatatacctactatgataaaggcgagaaaaccggagaatgtctgcttgatagaaccacagaagataagttgttaaaaagtttaatttccgaaaaccgtttgctttctattcatagtagtgagcctacattaaatgatatttttgttgatattacagggaggacacttcaatgagattgggacgtttaatttgtagtgatatacatttccaatggaaatatggtttctattttatctactttatattaacagttttatatgtgtgtgggattgcctctttgccgggacattggaaaacggatattgcttctatcatgatatactctgacccggcagcaatgggattgttttttatgggagcgattgtccttttggaaaaaagtcaaaaggtattaaatgctattgtagtgtctcccgtaaaaatgtccgaatatatactttcaaaaacagttgcgctgattgccatatctacggtaattgcaatgatattaggattagtttccggtagcaatcagttacttagtatcgcagttggtacggctttgacatcagcaatctttactatgcttggaattattgcggctacaaaaatttcaaacttgaaccaatttctcattgtgattatgccgatagaaattgtttgctttgttccacctatcgttggtctgtttgtaaagttaccagatatattccgcttttttccgttcacagcttgcatgaaccttataactggaaaaagcattttactatcgtttgatatggtacttgtaattgctacgttgattatcctctacatagttgcgcgacatacagttaagcatatgtggaaaagtttaggaggtgtaaagctatgaaaaggatattatccagtaccatacaggtatttagacaaatcaagagcgaccctatgatgtttgcagcttgttttacgccttttgtcatgggagctttgattaaattcggtattccctttcttgaaagaataacagatttttctttgcaagcatactatccgatttttgatttactactttctatcatggctcctgtattactctgctttgcatttgcaatgattacattagaggaaatcgacgataaagtgtcacggtacttttcgattacccctcttggtaagtcggggtatctctttacaaggttgggagtaccctcaattatttcggcaatcatcgcttttattgtactgttgcttttttcattagaaaagttgtccattggaatgacaatatgtttggcgcttctcggctcagtacaggcaattattgtttcacttatgattattacattatcaagcaataaattagagggtatggcagttacaaaactagctgcacttacattactcggaataccagcccccttttttattgatagttactaccagttcgcggttggcttccttccatcattttgggtagcgaaagccatgcagaatgaagcggttctttatttctccataggattggtggtagctttagtctggtactacttccttacaaaacgtctgtttcggaagctggcaggataaggagtcatattatggaaaaaggtagacttctgcaaaacaaaaatataaataaggctattcaggtttccaaaatcacactaatcatcaacctgagtttatcgctacttaaatttgctgccggatatataggaaagtcaagtgccatgctgtcggacgctgtacactcggcttttgatgtattaagcacaatcgttgtgatggttggaattaaaatatcagaaaaacagcctgatagagaacatccttatgggcatgaacgtatggaatgtgtggcttccattattctttctgtcgcattggctataacaggtgctggaattggatattcaggtatcaagaaaatcttttcagaacagtacaatacgctttctgctgctagtggaatcgcacttacggcggcagtcttatccattgttataaaagagtggatgtactggtttacaaggattgctgagggagtccatcaaacgattgaaaacaactttccacaatgtaaacattgtatggtacatgttaatacgaatgaacttctctattctgcataggacagggaagatgatttaaggctattgaaagggaaaggagggaagtaggttatggaacaatactggtggattatcattgttgtggttttgattgtcgttggtttacttaaaattgtaattatgaagaagtataaccaaaggagaaattctaacaatcgttcaaaagatagcgaggacgacaagatgtattaaggtttattgaaatctgttatgttgtagaatgatgtttttagatactagaaagtgctttaagggggctaacgttatggaaagctttgagtacaattctatacaatcaaatacaatttaataaatctttacaaaaaattgaatgcaatacggctttaaaggctcgtacaaaccatatgttttgtgcgggcttttttagtgcaaataatttttcaaattttttcggtttcaacttagcaaatcacacctgcaattccctatatggtgcggaaagagggacaaacacttttcacgtcataacggaaaggcggtaatgatattcgtatttgtgatgatgaattggcacaagccttgaaaaagctgtccgaacgtaactgtgaaaatttattgatgtactatttcttggaaatgagtgacaccgagattgcaaaaagacagaatatttccagaagtggaggaacgaaaagccgggcagaatctattgatttccatcctttttacgggggtaaaggcgcttgtcatctggctggctgcaatttaagatctcgcccatttgtttttgcgtgagatcacgatcttctcttagatttcggattctactatacattttcttcacaaacttattttgaggaaggttcgaacatgctaaaaaaaacgagataatagaaataggtatttatcaatttggaatcatttccaaaacagaaattatttttgatcaagaaatcagaaaaatatgtgaggataatgtctgccgcctgtacgggaagtcctgggcttgtcctccggctgtgggtacagttgatgactgacgccaatatgcaagagcactggtatttaatgccgtttatcctttggacaattccttcgattatgaaggaatgataagaggacacagtgggttcaaggatctgtgcagtcgattatatacagtgataaaaccacagttgcatttttttctcatattatcaaacgaaggatgtaaacggtgtaaaaactgtacttatccttcagtaaaatgcagaaattcagaaatgttatctccttctttagaaggttttgggagcaatgttgccaagctggaagaaactgcaaacctaaagtatatgaatgaaaatatcgtcacatatttcggaatgttgctgtattaaccatcatagaaagtgaggaatatcatgaaaaaagatgtaataggcattatctgacattaataaagcatataaacaccgtaataccacatcagaatactagttcttttaatattaacttttatcgttcgccaaactgccaggtcgattatattttctgtattcagtgggagacagagaaaattcctttttaaaaagttttgaaaaagccagctgatcttcgaaaccaagggaaccggcgatcacagaaacaggaagtcctgtcgtcatcaacagacggcaggctttttttaactttaattttagaagatagtgttttggagagtatccaaatttctcagaaaaaattctgcttagataatttggatggactccgaaagattttgccagatcttttatcactattttttctgaataattggtatctaaataaaactttacttcatctgcaacggatacttttccccagcttcgctcgttaaaagaaacatcttcaaagagcatgccgataatattaaggagcagactatttgccttaaaatattggcttgtcgtattcccctgcagacctagaatctgagaaatgacttcttcgtatttttcggtatcaagctgatggatgatataaatatcttcggaggaggtcataagctggtatgtgtaagtttgcgaactgattccgaggtagccgatccaagcataactccatggatcgtctgttgaagcttcataataggaaactttacccgcaggaatgataaaagcatctccagtggaaaggtggaatatgtgctcattgatatgaagttttcccttaccttttaacacgaaatgaattaaatcgtaggaacggtacttcggtccatagtggtatcctggtaaacagtcttcgtaaccagcactgtaaaaggaaagatcggaatttgatttgtaaattaaggagtgttgagtttctttatattctttcatggttttattataaacaaaaaggttaggtttttccatatttttttatgtaatttctatataaaatgaattctgtttattttattatgattgtagaaaaaaggagaaaggagagtaatacaaagtgggtgggatgagacaaaagtatcatcttgaaccggaccggggcctcttaaatgacccaaacggattggcttattttaaaggaaaatactatgttttctttcaatggaaccgattcgcaaaggatcatggatacaaggaatgggggctttttaaatcatcagatcttttgaactggacatttgaaggaagcgccttgcttccagatcagatttatgatcaggacggcgtctactcgggaagcgcatgtgtgatagaagataagttatgcctgttctataccgggaacacaaaatcggatggtcggagaaaagtttatcagtgcatggcggtgagttcagacggaagaaaatatcttaaacacggatgcgtgctggagactccggcagattatacggaacatttcagggatccgaaagtgtttaagggaagccgccagggctattttatggtaatcggtgcccagaagagtaatgggaaaggcgctgttgctctggcaagttcctgtgacggagttcactggagcgtaaagggaaatctggctgaaacagagatgtatgaaatggtggaatgtccggacctgtttgaactggacggtaaacatgttttaatgttcaatcctcaggaacgtgacaacgataacgatgtatgcggagttagtttttccgcatataagatcatggagtttgatgagaaaacggaaacggttggtgaccgtgacctcgataaacactgtcgttttgatcaggggtttgacttctatgcaccgcagacattctgtgatgataagggacgaaggattatgttcggatggatgtcacgaatgaatgaaatgcaggagcagatttttgcggctgaagagagaaacattcattgcctgacgcttccaagagaactgaatgtgaaaaatggcaggttatatcagagggtcccggaagaattcgaacgattgaaaggaaagcaaattcctttagagatgccgaaaacgaaagaaataaaagcggtattcccccagaaagcggcatttgttaaagtgtcaggatcagatttggatcagggaatattcataaggtttccagaagatggtacaaagatattctataatggaagtgaaaaagttttcacatttgtaaggtatgactgggtaaataagacggaagaacaaaagagttttccaatggaaatgctttattcattggaattatggctggatcagtccagtattgagatatttttaaatgaaggggagtatgtgctgtcttcgaggatctattcaaaaggagaagggcaaaccgttatttttaaaggaatgacagaaaaatcagagattgagtgtaaagagatcaatacaggaggtatgcataatgagtgacaaagagttggcaaaaaagattgttgaacttgttggcggcaaagaaaacattgtttccgtaaggcactgtgcaacgaggcttaggatagttgtgtcggacaaagagaagatccaggtgaaagaagtagaagcgttggataaagtaaagggatcttttttcaattccggtcagtatcagattattctgggcacaggattggtaaacagaatttatgatgaagttattaagattaccggcggaccagatgaggggcaggttgaagaaaagaaagaagtggtttatggaaataaatttcagagagccattcggatgttttcagatgtattcgtaccgattattccggttctggtggcgaccggtcttttcatgggtctcagaggccttctgacacagcaagcagtgctgggagtatttggaatgacaccggaagatatcccagcttccctgctgacatttacacagattttgacggatactgctttttcgttcctgcctgcgctcgtctgttggtctacatttcgcaatttcggcggaagcccggtcatcggaatcgtacttggtctcatgcttgtaagcccgagccttccaagttcttacgacgttggatcaggagtggcagatccgcttgtatttttcggatttatcaaagtggcaggatatcagggatcagtcctgccggctttcgctactggtattatcacggcaaaatttgaaaaatggctccgaaaacatgtaccggatgcccttgatctgatcgtgacaccgtttatcacactttttgttggtattgtgatggctctgtttgtgcttggaccgattcttcactatgtggaaaatggagttttatttgtggtagagaacctgctgttccttccgatgggaatcgggggacttatctatggtagttttggacagttgcttggaatatttggtatacaccatatcctgaacttcctggaaatcagtatgctggctaatgatggatggaattacttaaatccaatcggaacatgcggaaatgtagctcaggcgggcgctgttcttgcagtagctatcaaagcagcttcaaataagacaaaacaggtcgcatacccttcctgtctgtcagcgcttctcggaattacagagccggctgtttttggtgtaaatctgcgatttgtgaaaccatttatcatgtccatgatcggtggaggaattggaggtttccttgcttctttgttccacttaaaagcaactggaatgtcaatcactggtattccgggaactcttttatacctgaatgaacagcttccgatttatatatttgtaaatgtagtagcttttgcggtagcatttattcttacgtggttgtttggatttaacaaaaaaatggagaatgcggcatgagtattgtcttaaaggatcacatcgtacatatcagtaacaacaagatcagttatgtgatggaggttgttgacgggaaatatctgatacacaggtattttgggaaaacaatccggaagtacagagggacaggaatccctctgtattttaaaagaggatataataccagccacagctgcagtgtggagaatgtatcttttgacgatttcccatttgaatatcctgtaagagacagtggcgattacagaatcccagcaatttctttcgtgacagcttcagggatccggcatgcggattttagattcgagaactggagagttttaccggataagccatcacttccggggcttcctggcattattgcgaaaaaaggagaggctgaaacgctggaagtggtctgcagggatgagatggcagaattaaaattgtatctttattataccattttaccggatatcggcgtcctgatgcgtcatcaaaagctgcaaaatacaggcagccgatctatatgtattgagaatatccagagcatgtctctggaacttccggcgaaagaatacgatggtctgattctctatggaacacatgcaaaagaggcaaacatggaaagatttccgcttcatcatggtgtacagcggattgaaagcgtgcgaggcagctccagccttcaatatcagccgtttgctgctctgatggatcacgagacaacggaaacctcgggaacagtatatggttttcagcttatttacagcgggaattttcttgcacaaatagaaaaggatcagttcggtaacatacgtgctcagatggggcttcatccggatatgttttcctgggaactgaaacctggggaaagcttctgtacaccggaggcagtgttaaattacagtggcaacggattaaatgaaatgagtcataattttcaccgtttgtacagggaacatctgattcccggggaatttgccggaaaagtacgtccggtgcttttaaactcgtgggaggctatgtactacgatgtcagtctggaaaaaataaaggagcaggtaataattgccaagagactgggaatcgagctctttgtactggatgacggatggtttcgcagaggaaacaacagtcatgattccatgggtgactggatatgcaatgagaaaaagctgccgggtgggatccggcaggcggcagacctggttcacagtcagggacttcagtttggtctttggtttgagcccgaagcgataagcctcaaaagcgatctgtaccaacttcatccggactgggcccttggcgttccgggatatccaaatacggaagggcgtcatgagtacctgctggacctgaccagaacagagataagagattatatcaaaaacgttctagattcctatttgagggaaggatttattgattatatcaaatgggatatgaaccggcctctgacagatgtgtattcacaagcttaccgggatggaaatagtaaggaaaccagccacaggtacatcctggggttatatgaaatccttgagtggctgaaaactgcttatcctaaggttctggtagaaggatgttccagcggaggagcgagatttgatccgggcatgctgtattatgtgcctcaaaattgggccagtgacaatacagatggctatgacagagcggtaatccagaatggtttcagccttctgtatcccaaagaagtaatgggagcgcacgtaagcattacgccgaaccatcagacgggaagaacaacatcactgcgtacaagatttcagacagcccgttttttcaatcttgggtatgaattggatgtaacaaagtgcagcgaagaagaattaaagattatttcagagcagatttcacaatataagtcagaacaggaattttttagtaacgacattttttaccgtcacgaggttcctaatcagaattattatatgtggtcatgcgtggggaaaaaagagtgtaaagtgataatctatcagaaatttttcaatcccctgtactctcatgggtgtttccggatgcttgggctggatcctgatgcggactattatgaagaagcaacaggcagaatatacggaggagatgaactgatggaaattggaattacggtgcctcttgtaaaagaagatttttacgtatttgacattcatctgataaaaatcgaggagaaataataacggtatgaaaataaaactgtttgccagtgatctggatgggacattgcttaatgaacaacataaaatatcgcaacaaagtgctgacgcaatccgaaccgcacagcaaacaggaaaagtatttctggcggttactggcagagcgtgggggacggcgtctctcttattgaaagaggcgggcatatcctgcgtatgcttttggcgtatggaattgaatttgaaattaatacaagttgcggtgatttttctacagacacttgtgtttataacggtgtcaaatataaggaataataaagcagctgtctattcgtcccattggcaagctttcaaatcgacatgccaatcatctttaaacacagcgccttcttctaataaaagcagtccttgttcatgccagcccgggaccagtcttccggcgtgattgaccacacggtggcagggataactgccgtagtactctgccatgccaaggaccctgcccacaagtcttgcgtttttttctctgccgatcagacgggcaatctggccgtaagtcgcaaccttccccaggggaatttcttccactacagagaggatttcataaattaaacgctcatctaaaatctttttcatatgtgcaacctcaaaaatgtattacagatcatattaatcaaatcatgcttcaagaaagaagaaatgtcaagatgaaggatgacaaaaaattgaatggaatctgcacagttctatgttatactgaacatatacatagaatggaggttgagattatgggaatttggatgatgaagcactgacagcagggcgttggtgtttccatagccttgctgatcgataagaggcgtaaacaaagaaacggtcaggaggcaaaggatgtcatattttaattatcagtcaaaaaagatttattacaaagaaacaggaagcggaaaacccgtagtgttattgcacgggaacacagcatcttccaggatgtttgaatttatactgcctttatatgaagataagtttcatgtaattcttattgattttttgggccatgggaaatcagacaggctggaagcatttccggcggaactctggatggaagaggcaagacagactatagctctgcttgagcatctggatcttggaaaggtaaaccttgtgggaaccagcggcggtgcatgggcggcagtcaatgcagccttggaacgccccgatctggtggacaaggtagtggcggacagttttgacggacgtactctggcagacgactttgcagagaatctgcttaaggagcgggcagatgccaagaaggacgaaatggggacagcattttacgagtggtgccagggggaagactgggaacgcatcgtggatatggatacaagtgcgatggtacagtgtgccaaagagaagctgcccttatttacaaagccgctgagcgcgctaaataatcctctcctgctgatgggcagcaagggagatgacatgtgcagatcagattttctggatgaatatcgtgcaataaccaaagaaaccaatgcagaagtatgtattttcccggaaggggtacatcccgcaattctctcctgtgccgagaaggcggcagaggttattgccggattcctggaaggaaaagaaacataaggaggctggaagatgagaatgccggagaagattgaagcagacatgtttgcaccctgtgggatgaactgcatggtttgttacaaacattgttatcataaaaaaccttgtgccggatgtctgaacagtgaccggggaaaaccggaacactgcccgaactgcggcggtattatttccctgcatgatgcagaatgcagcgaatgtcaacataagatacacacataacgcaaacgggggaaggtgaaagcacttgtggaaaaaaagatgagctgctgcggcacagctgttattgaaatgtctggtgcagccggtataacgctggtttctgaaaaagacagaaatccgatgtacacaacaacttatggagttggagaagttatccgggatgctgtgcagaaaggctgccgaaaatttatcattggaattggcagaagtgcaaccaatgacggcgggattgagatgcttcaggctttgggatacggattcctgaatgccgggggtaagcaggttccttttggagccagaggactcgctgagcttgagaggattacggacacctgcgtgcttccggaattaagtgaatgtaagtttgagatggcatatgacgtgaccaatcctctgtgcgggaatcatggatgcagtgcggtctacgggccccagaagggggctgaatctgtgacaggcattgatatttcagcaaaatgttagagactgcaggagaaaggaacagccatgaaaagatccggtaccgaagatatgccatggaagatctggactttccaaaggaatcttttgatgtggtcatcagctcacttgcattccattacgtgaaggattttgaacgttggcagaaaagatcagccaatggattgcgccgtcctatgatgctgatcgtggcggcggaaaaggattgacaaaaggaggtgcggaatgctggaagacgatgtgataaaggcggcagccggggaagagccgctgatacaaaaaaaatatgaaggtgagatactgtgtctggaaatgcctgtaaaggtagaatttaatcatgtttgtttcaaaaaatgcaggtttgtatcatgtgatttcagcggttctatgttctacaatgtaaaattcctgaactgtgatttctctaactgcagatttcaatcctgctatttaaaagaaacggaaatatggggatgcaaaggtgacggaggagacttcagtcagagcacgttccgcacaacaatggttgaagaaggatgttatcactatgccaactatgaaggcacgctctgggacggctgcagacttaaaggagttgatttcagtgaagcgttttttgcggaagtaaagtttaaaaaaatccggtttgaaaaagtgaacctttcccgagtcgatttttttaagacgcagctggaaggcatcgacttatcggacagcaacatcgagggaatcatggtatccgatacttttcgggaactgcgcgggatgaagatcggcccgatgcaggctatggatctggtgcgtttcttaggagtgaaaatcatctgagttttgttataagcaaatgggcacagagaataaaccgtgttatgctaaataatgccaggcagaaagccggaagggtcagggaagccgctttatcgtcactctgaatttgaagatcgccgattcggatcaggttacggagcacaggatgacgggatttaaaatacaaggtgtgccaggggctgattcccggtgttcggacagactcaggggcaaacggcttctgctggtagaagataatgaacttaatatggagattgcggagacgatactcactgaagtgggattcgtggttgaaaatgcagagaacggaaaggaggctctcgacaggttcctggcatctgagccgggacattatcaggcagtccttatggatctgcagatgccggtcatggacggatacaccgctgcaaaagagatccggaacagcacacatccccaggctcttacggttccggtgatcgctctgacagccaatgcctttgcagaggacatggctaaagcactggcagcaggcatgaatgatcatgtctcaaaaccgattgactacaagcgcctcataagagttttggaaaaaaatatagagtagagaaagatgaggaatgacatgaaagaccaaatactgttgatcaatgatctggccggttacggcaaagtggcactgtctgccatgctgccggtcatgacccatgcgggacttaatttatataacctgcccactgcactcgtctcaaacactctcgactatggaaagtttgagatattagagaccacagagtatatgaggaagacgatgaaagtctgggaggagctgggattttcttttgacgctgtctgcacggggtttatcgcatctgaagagcaggtaaaactgatctcagactatctgagagatcagaaagagaatggaacatggatttttgtagatcccattatgggagatgaagggaagctttacaacggaattgaaggaaaaaccgtaggttatatgagagatctgtgctccctggccgatgtgatcgtgccgaacctgacggaagcaagctttttagcggaaatgtatcagggaaaggaagtcatcacagaaggagagagcagagagcttctcaaaaaactcagaaagcttggtgcaaaatctatcgtcatcacgagtgtaaagacggaggccggagattttgttttgatctatgaccatcagacggatacggtgtctgagcttccatttgaacagattccggtgcgttttccgggaaccggagatattttctcggctgttctggcaagtcaggtactgaacggaacacagcttgacaaagcggccgagcgggccatgaccgccgtcagagagctgatcctgctcaacagagagacagccgataagtttaagggaataccgatcgagaaaaatctggaggtgctgaattttgagacgtccgaagattaaacttacactgatcgaaagaaaaggggatcacggttgtcaccggggacataaggccggagacagttttgattttgatacggagaggggacagctttgtccgatggctatgcatgtggcgtttccgtacgttgatattttaagatatggcggaaacattccgggtcagccggagggaacggcggtgttctgttgtccggacgcggatacgattaatgtctttaaagctgaaatcatcagtgaagaatagtgaggagcggttaatcagagttagccgctcctttccgaattttacggtatccgaaagataccagatttcctggcggtaaccatcctacttttttgtgcgtactttacgtttggagaacggggaattatcatgaaattagaatctaagcattcacaaaggaggataaagggatgacagcagaagcgtgtattaaattattaagagagatcaaagatgcggcgtttgcaacggtagatgaagaaggacatccccaggtgcgcattatcgatgtcatgatcgcagagggagaaaagctgtatttttgtacggaaagagggaaagacttttaccgacagctgatagcaaatgaatatacggctatcacagggatgaacaaagaatttcagatggtgaggctttccggcccggtgaaaaagctttcggatcaaaagatgtagattgaccgcgtttttgaggagaacccgatgatgaacgatgtgtatccgggggaaagctgaagcatgtatcggctgcgggacgtgcagggacgtatgtccccagaaatgcattagtgaaggaatgccgtatataatactacaggatatcagtcataaatatctcattcagccgctggataataaatgacggtattgtaagttgaaattcttcctgaagtgaaatataataaacaaaaacatgtaagggagataaattatgaatgtaatagaaatcgtaaagtcgattgtgctcggtattatccagggaatcacagagtggcttccgatcagcagtacgggccatctcattctgtttgacaacatatggccaatggcttcaagtccggagttttttgaagtattcaaagtagtcatccagttcgggtctattctggcggttctggttctgttttttcacaaactgaatccattttctccgcaaaagagcagaagagaaaaacgggatacgtataacctttggaaaaaggtcatcgtagggtgcataccgattattatcgtagggcttccgctggatatgatattggaagattatctatcgggtgtctatgtaatagcggcaactttgatcttgtacggtattgcattcattgtcattgagagcagaaacaggcgtccatccatgcggtcactggaggatctgacttataaagcggcgttttttattggatgttttcaggtgcttgcggcaattccggggacatccagaagcggtgcaacgatcctgggagccgtgttattaggctgctcccgttatgttgccagtgaattttcatttttcctggcagttccggtcatggccggggccagcggtctgaaactgatcaaatattttctgaaggtaggaatgttttcaggcagtgaatggcttcttctgactgtgggaaccgtggtttccttcttagtgtccatcctggcaatccgtctgctgctaagttacatccgaaaacatgactttaaggtctttgggatttaccggatcctgcttggtatcgtggtaattgtatactttggattcctggcataataatgaaagaaacaagtttggaataaataaaaaatgcatctgttacagatttcatttttctgtaacggatgcatttttaatgggaaatatatattttttgtatttttaactatttgcaaaatctctggtaaacatgtcgctcttttccacaaactcctccatatttttaaaaccaaggcggtggagaagttccatcacatacggattgtcaaggggtgttttatatggtgcttcttttccgtaggtctctacatttctttttcccttgtccttatcaatgatgattttaggcccgccgacacatccgcctctgcatgccattccctcaaaaaagttggcgtctgtctcgcccttttggatctgttcgatcatggccttgcatgcagggacgccgtctgcctgctgtgcacggaccggaacttcccttcccggactgagtttttccacagtagaccttacggcctcgctgacgccgccggtgtgggcatagatcctgcccgccctggaggaatgttccctgtcgttgtcggcaagttcttccggccgtatctcggccgcgtcgaaaatatcctgtacttcctgaaatgtcagtacatagtccactgcatctgcaatgtccggttccctggcttctttcttttttgcgatacacgggccgatgaatactgtaaccgcatcgggatgaatatgctttaccgcccgccctgccgcgatcatcggggagactgctcccggcacgtgggggatcagttcatggtagattttgcggatcatggcgatccagaccggacagcagcagctggtgagctggaaatcatctcttgaattgatatgcttgtcaaattccagagcctccttcagagtcagaatgtctgcaaagaccgctacttccaccattcctttgaatccggcggctttcagtgcacttctcagctgtcctggggaagcattttcatactggcctacgaaagcaggggcgatcagggcataaacatctttttctttactgcgcacttcttttaacacggggaagatatccttgctctctgccagcttatccagcctgcatgactcaatacagacaccgcatccgctgcatttatccggatcgatagccagctttccgtcaacctcttctatggcgtcaaaaatacagctgtttttgcatgccctgtcataggcacagctctcacatgattccgtgtggatgaccggggcatactggtccggatttaaaaggcagtcaagctgatgaggatcatagtcagcctcgctgatatcttcatttttcatttgtttttgaagcaattctttgtagagttcatggaatgatgttaatttttttacttccggcatatgaatcactcctattctgcattcagtgcggccatagtgatataattgtacggctgattaaaatgcggaaggaaaaacaggtcgaacagttttaacttatcaatggtgactttttcctggatggccatagaaaacaggtggatcgccatggagatatcatagtcggaacaaagctgtgcaccgaggattcgtcgcgtctttttgtcataaacgatgcggatcacgaccttatagttgtccttctccataaacccggctttctgccagtcctcataatctgtggcggcggcatcaaaaccgagtttttttgttcgctccagggaaagcccggtgcttaccatgtttaagccccagatgctgatcccgttagaaccctgtacccccggggatttcagctctgtaccgcaggcgttgtgggcggcaatgatcccggaacggaccgcattggtggccagtgcgatataatccgtatcttcgatggcattgttgtaaacggtggcacagtcacccacggcatagacgtccgggcggctggtctgctgcatgagatctgtaagataagcgccgttgttgtgaaactgcttaagctggccgtttccgagcttcgtgttggggcggaagcctacacagaatatgaccatgtcggcgtcgtaggtgttttggtctgtgactactttatcgactttcccgtttccttccagctgttttactttctctccaaatgcaaggcggattccgtggtcagacagctgcttttccatgcgtttgcagaatatatcgtcatagtaggcggagagacaggtgtctgcgcagtcaattaaagtgacttctctgccgtttctctgaaaagcctcggcaagttccacaccgatatatccggctccgacgacagcgactttctttatagaggtatctccaagcttttcgatgacttccgccgcattctgatagagctttacaaactggacattgtcaagactcatgcccggaagctgggggcctaccggagtagagcctgtggcaagaattagcttgtcgtaagggtactcacagtctttgccggcagcatctttcgtatagacgaccttgttgtcaaaatctacggaattgaccgaggtctccatatagatctttgcgcccttcccttccaggatttctttgctggaataaaacagcccgtcaggcccggaaatctgtcccccgatccagagagccatcccgcagcctaagaaactgatattggaattggcgtcaaaggcggtgacgtccacatccttataattgtcgagtatcgtattcagcgctgcggtacctgcatgattcgcaccgatgacaataattttttttggcataatccttatctcctttatatctgataacacttggtataataatcagtatgccaaaaaaagaaaaaattattgattagaggaggaataaaacgatgctgatcttaaacgggaaaatccttcctatggaaggagaaactatagaacacggctatgtgcagacgaaaggaaaggtaataaaagaactgccgtgtggatgaccgggtcggaagcctgaaacccgggaaggatgcggatctcgcagtattttccgacaatccggtgagtacccttaccaagacgctctatacattcatcgacggtcagatcgtttaccatgaaggagataagagttagggttttaagatgaccttgatgcactcgtcctatttttgtcgaagattttgtatgcgtgtttccctttactaagaggaaggcggtgtgtgatgatatcggtggcgtcaaaggaactgtctgggattgggaaaggatagggtccacatatttctgtgcagggcactgttccattctcagtgtgatattccggtcaaaaaagttgcccagagggaatagattgtatcttccaccgtagacaccgattattgtcacggttccgcattttctcaccacttcggatgagatctcgatggcagacttggagccggcctggagtttcagggcggattccactttttccacaaccgacatttttccgtcatacccacgcagtcgatgacacgttctgcacccagtaaaaaggcccatttgattgtcaaaaggcgactggaccacagcctgagaccacaacatcaggaataagacctgttcatcttcaagttcttccgggacttttacaggccctacattggcataggggacccggagatactgtgcctgtcctccgggatatccgccgaaggcgtcactgtacccgaacaggccgccggctcctccgtttggatcagatggagatcggaagcgcagatggctgtggaggtcactttgacgatgatattattctccttttcgatcctggggtccggaaccttttctactcccacatctttcaccccgtgataaacaatcgcatccatagtttgtaccgtcctttctaaatatcatatttactttttaatatggcttttgtcatggacagctatacttgacaattaactcttacggttgtaagattttaaaaaaaggagacaaatgactatgagaatcataaagattttgatcccaatgctgggatgccttttctgcctttctgcctgcggcacagaaacgaacaagaatccgaaaggaagtacagaaaagatcaaaaaagaactctttgcggcggcagactgttataagacgatttattcgtccgcagacaaagggaaaggcataaatccggtattgtccaagaaggagatccacagaatcgtttggcggctcggaacatgcggatattccgccgcgtgtatggaaaatgactgtgatatgcagaatggacggacagtggagaaagctttgcggaaggccgaaaaaggcgggaagacttccaccgtgttttttggtgtcaccagatccggtggaatccacagatatgaacttaggatgaaaggaaagaaagcagaattcacagacgcctatctggactgggacaaacagggaaatccggcggtatcctatgtaaagacagaaaaagtatcctcttttagaatgacagagaagggctggctgatctgggagaccatacatacagaaaatgaggagatggacacccacagtatgatccgcatccgtcccctctcaaaagaataccgtagattttgcaggagatatattgaaccggtgggttacagaggaaataatctgtttcttaccgactgggatgaaaaacagccggggaaactttatatgaatgatctctatgagtatctgtaccgtatagagaccggcagatattttgacggggacaacgggacaaaaggaatactgtcagaagaatttgaacttctgcttcaaaaatatcttccgttttcaaagagacagatccgtgcactggcagacagaggcgaagacggaacacgttatctgtgggagcctttaaggtgcggaaacttaattccccagagtatgccggttcctgaggtgatccgggcagagtataaaaaagacggaaggatcatcctcaccgtggatgctgttttaaaacaaaaggggacggactgcctgttccgccataaggtgaccttaaaaaaatccgaggacggcagagtgcggtatatcaaaaatcagatcaggagctcagataaagagagagttttagattatcagaaaaggaaccgataaagctgtcagacgggaaggttttctgttataatagcagaaagtgaagacaggaggttttgagtatggaaatatcaaaagtgacggaagtattcttcagccctacatacagcacggaacgcattgtcagactgattggtgaagcgtgggaagaaactcatcaggagatcgacctttccagaataccaaaggaaggggaagtacacgaatttggagcacaggacctggtgatcttcggagtcccgtcctacgggggaagagtgccggctccggctgcagagcggtttcgaaacttaaagggacaaaagacaccaatcatccttctgaccgcattcggaaaccgggactatgacgatactcttcttgagatgaaagacctggcagaggagcagggatttgttcctgcggcagccgtggctgcagcggcggaacattccattatgcgccaatatgcagaaggaaggccggacagccgggataagagtgagctcacggactttgcggtgaagattcgggaaaagatagagcagacagaagatacagaaagggtctcagagctttccgtgaaaggaaaccggccgtaccgggagtacaatggcgttcccatgaagccttctgccggaaaacagtgtaagaaatgcggtctctgtgcccgtctctgtccggccggcgccatacctgcagagcatccggaagagacagtgaagaaaatgtgcatctcctgtatgcggtgtattgccgtttgtccggaacatgcaaggagcattagcagaccgatgctccttgcagcatctatgaaactgaaaaaagagtgcagtgaacgaaaaaggaatgaattgatcatatgaagccagaactgattatgctcgggaccgggcatgcaatggttaccaaatgttataatacatgtttttccatccgcaacggcgaggaatatttcctcgtggatgcaggaggagggaatggaatccttttaaggcttgacgaagctcagattccatttgaacagatccgcagtatgttcctgacccatgctcacacggaccatatcttaggcgccgtctggatcgtccggaaagcggcgtccatgatgctttcggaagcttatcacgggtattttaccatctactgccacgaggaggccgcaaagatcctgaaagagatctgccggctcacattggcagaaaaatttttgaagtttttgggcggtaaaatacggatacaggaagtagaagacggagaagagatggatatctcagggatgcacgtccgcttttttgacatacattccacgaaggcaaaacaatttggatttcgtgcagatttggaggaaggcatttcactggcatgtcttggtgatgaaccgtacaacagcatctgcagaccttatgtggaaggagcggactggctgctttgtgaggcattctgtttatatggcatgagggatatattccatccatatgaaaagcaccacagcacagcgttggatgccgggaatctggccgaaaaactcaaagtcagaaatctggtgctttaccatacggaggataccgatttaaagaaccggaagaagcagtatacaagagaagtgaaactgctgtactcagggactgtctatgtgcccgatgacctggaggtactgaagctgtgacagaaaatgtcagcagccaagaacactcagataatgccggaagatctgtacatggactttttcatccatggcgatccggtttagcacggcgcagacaaacgggtcctgtatcttagaggcagtctccagataaaagctggcggccgcctcttctgcttccatgttgcttttcaatgcctggtgaagatcctttgtataatcaggggcgtctccgctccagcattggcaggggtcttcggcgaatctcggatcgccgcccagaagggagaccagtgtgccgagcatctgcatgtggtgcatttccacctttgctattttcatcagagtatcggccagtgaggaatactttttgaagaagatccagttttgataaatgtatgtggtgacagcagtcagttcgctggactgggctctcagtgcaggcagtatcatttccgcataccgggggttccgccgggctgcttttacaggcggatagggatggggatctgtgaccgccggatggtaagaatcacaaaatgtcatatgaaaaatcctttgctgtttcagttgtttttataatatgcacgcccggccggacggtgaatctttatagtacatttcaaaggcatatgcatattctataagtactcagatttgaagggtgtagggaccggtgagacagcaaagaaaagaacggatagccatgaaagtgtctgtcaacagtatttttgtaaacctggtactgtcagcatttaaattatttgccggcattgcggcaagatccggcgccatgatctcggatgcggcccactccgcatccgacgtgttcagcacgatcattgtcatggcaggggttgtcctggcttccagggaagcagatgaaaaacatcagtacggtcacgaacggatggaatgtgtggcggcggtcctgctgggcgcagtgctgtgcataacggggcttttcataggagctgccgggcttcagaagatttttgcgggggatcagggaaaacttgtgatccctggagccctggccatggcggccgccctgatctccatagccgtcaaagaggggatgtactggtatacgaggaatgcagccaggaaaatagattctgctgcgctgatggcggatgcgtggcaccaccgctccgacgccctatcttccgtcggcagccttatcggtgtcctgggagccaggatggggtttccaattctggaccctctggcaagcgtggtgatctgcatttttattgtaaaagcgtcctacgacatttttgcagacgccgtgcgcaaaatgatcgatgagtcgtgcagcagggagacggtggaacagatgagaagcgtgattcttgaccagcccggggtcagggggattgacgatatccgaacgagaaaattcggggccagggtatatgtggatgtggagatctgcatggacggaaatcttccgctcaggaaggctcacgatacggcggagaaggtccacttaaaaatcgaggaaaagtttgcgccggtgaaacattgtatggtacacgtaaatcccgtcaagaatgaagatgggggaatgaacgaggaaacgacaaaatgaaactaattttatcttacttgaaacattataaaaaaatgtttgcactgaatgtattttcggtattcggctttgctcttgtggagctggggataccgaccatcgtagcgtggatgatcgaccggggcgtaacggaaaaggacacggcttttatttttgagatgggaggagtgatccttcttgtctctttgcttggaaccgcggggacgatcctgctgggctactgctgttcctatctgtctacctccatcacaagggacatccgaaatgacatgtttgaaaagacgcaggaattttcacacagggaattcaaagaatttgggacggcatcccttattacgagaacgaccaacgacgctttccagatccagatgtttttaaatatcctgttccgcaccgccctgatgacgccggtgatgaccgtcggcagcatcgtgctcgtgctgaaagcttctttaagtctttctatggtgatcctgggaactataccttttatcgttgtgggagtgatcatcgtggcaaaacgctctgagcttttaagtgaacgccagcagtcctcgctggaatggatcaaccgcatttccaaggaaaatatcagcggtatccgggtcatccgggcgtttaccaacgacaggcatgaaaagaagcgctttgatgaagccaacagcgcctatatgggatattccaaaaagctgtttaaactcatgtctgtcacccagccggccttctattttctcatgaatttagccggtatgctcatttactggatctctagcattatgatagagcagggagggctgaacatcggacagctggtagccttcatggattatctgttccatgtgatgttctctatcatgctgttctgcctggttttcatgatgtatcccaaagcggcggtcagtgccaggaggatcaccaggatcttcgacgctgtgccggcagttgaaaatacttcgggagaaggaggcagccctatccgcattgatgagatcacgtttgaccatgtgaccttcgcatacccggacggagaggaagcagtgcttaccgacgtgtccttcactgtgaaaaaaggagagactatcgcctttatcggcagcacgggttccgggaaaagcactctgatcaatcttgtccccagggcttatgatgtgtccggcggaaggattttggtcaatgggacagacatcagagatatagatcttagttccctgagaaattctatcgggtttataccgcagaaggcactgcttttctccggaagcatcgcagataatctcaagtttggaaaagaagatgcctcttttgaagaaatggaggaggcggcaagaactgcccaggcatatgattttatcatggaaaagggcgggtttgacgtacagatcacggaaaatgcaaccaatgtatccggcggacagaggcagaggctttccattgcgcgggcacttgtgagaaaaccggaagtctatattttcgatgattctttctctgctcttgatttcaagacagatgcaaagctcagaaaagaactgaaaaaggttttaaaggatgcggtcatgatggtcgtagcccagagaatcaccagcatcatggatgcagataagattatggtgctcaatgagggacgggtcgcaggagccggaactcacagagaactgctggaaagctgcaggatttatcaggagatcgctgcatcccagctggataaggaggaactggccgatgattaagaaaataaaacaggcgggtgcggtgatcagcagactcaggccgtttatcgctccttataaatggggatttatcggagcggttgtgatgacggttttaagcgtggccgccatgacctcggcaccaaggatcgagggaatgatcactacccggctggccaaagacgcggcacagatcgcagggaaagtacccggcgcgggagtccggtttgatgtgatcgtgagaatccttgcagtacttgcggctgtctatattataaagatggcatcccaggtcattagtatgttcctgctgaccaattccatccagagcgcaatgcatgatatgagaaatgcggtgcaggataagatccgaaggctgccggtgaaatatttcgatacccacagctttggagatactttaagccgggtgacaaatgatatcgactcggtatccaacggtttgcagcagagttttacccaggtcatcagcggagtcctgacgctcatcctggtccttgtgatggtatttaccatccagccagtgatggcatggctggtcgtgctgatcattcctgtcagtattttgatcagcgtggctgtggtaaggaaaagccagaagcacttcaaggctcagcaggactctcttggagaactgaacgggacgataacagagctctatacgggatacaatgagattctgctgttcggaaggcagcagtcttcccgggagcggtttaaagagatcaacggaaggctccagaagcatgctctgaaagcacagtttgtatcttccatgatgagtccgctgatttctctgactgtatatctctgtatcggaggtgtggcagtatccgggactgtctttgtaatacaggggatgctgaccgtgggcaatctccaggctttcatccgctatatctggcagtgcaatgaacccctctctcaggtggctcagctctcagctcagatccaggcggcatttgcagggatgaaaagaatttttgagatcctcgatgaacccgaggagattcccgatccggaaccgggaacccgtatctccgatgtaaaaggagaggtttcatttgagcatgtggcttttggatacggagataaaccggtcataaaggatttggatattcatataaaaagcggccagatggtcgccatcgtgggtcctaccggggccgggaaaacaaccatcatcaacctgctgctgcgtttttatgacacagacagcggaagaatcctgattgacggcgtggatatcaagtccatgaaaagagaagacttaagaagcatgttcggcatggtccttcaggacacatggctgttttccggaacaatttatgaaaacatccggtatggaaggctggatgccagaaaggatgaggtgatcgatgcggccaagacggcaaatgtccatcactttatccggacgctgccgaaaggatatgatatggagatcgacgaggaaggaagcaatatttcccagggtgaaaaacagcttcttacgattgcgagggcagtgttaaaggacccgaaaatattgattctggatgaagctacatcttccgtggatacaaggctcgaaatgatacttcaggaagctatgcataagctgctggccggaaggaccagctttgtcattgctcacaggctgtcaaccataaaaaatgcagacctgattcttgtgctgaaagaaggccggatcgtggagaccggcacacacacggaactgctagaagaaaaaggatactacgaacagctttaccactcacaattttccacataaaaaaatcaccaggccgtattttgtcaggtctggtgatttttatgcttggattaaagcaggcagttcagtactttcaagtgtttcagggcatggaaaatcccatcctctttataatgccgggtgacgtaatctgcggctcttttcgctgcccgtgttgcgttttccatggcaacggccgtaccggcggcctcaaacatgtgaacgtcattgtctccgtctccgaatgcatagctgtcatcctgtgaaaagccgagagcactggtcgcataggcaacagcatgtcctttgttgaaggatacgctggagacatcggcggagccgtcaaagtggtcattgatgatatatttgccgtcaaaattctgcttgatcgtctttagatgttccgcatccctgtagatgatatcaaatgcataggccctgacatcccggatgtcccagctctcttcatggattacatcgatggattcgtatggtctcgtatgtccgtacagatacagcggattgccgtggtatacgacaccgtctccgaggagacagtaggagcactgggaaaccctgcacagcttaatgatttctttcagttcggcgacggtaaagctgttgtccagcaggacgcttccctcgtgctctatgcgtctgccgtttgcggctataaatccgtcggccagcccggaaaacatatgcctgatatagccggcaggccttcctgatgcgatcatgaccgtgtgcccttttaacctcagttcccgaagggctttctgattcgagggaaggatgtcttcctgatccgcaagggttccgtcgatatcaaagaaaaaaatttttttggacatagtatgatacctccattctgattgcagttattataccatatatgcagagtaatgtgtcacttaccctctgttttttaccacttggctgtttttcatttacagcctcacggcctctgctataataaagacgtggagatgaaaagatgaagatacggattgaaattgatgaaaatttaatggaagaagaggtcatcatccggtgcgccggtttaaatgacatcgtccgggaagtgcagaaagcggtctcggaggcagcatccgggacacagacggccgtgttttccaagggagagcaggagtactatttcccgctttccaaggttttgttttttgagacagacggaaacaccatcaacgtgcatacggcggatgatatctacgagaccaggtaccggctgtatgaactggaggagatgcttccggggtccttcatgaggatctcaaagtcggcagttgtcaacaccaacaggatctattccatcagcagggggatgtcagcttccggcgtcatacagtttgaacatacccataagcagttgtatgtgtcgagactttatctgaaaccgctgaagcaaaaattagaagaaaagaggatcggaagatgagaaaagaaaagattttctggggattgttttttatctttggagcagtgttcattatttttggaagactggggtacctgagagaagtcagtgtattcagccttatgctgactatatttttcgcagccatgctgatcaaaagcctgatgcatctggagtacacgggaatcctgttttccattgcatttctctgcattatttatgcagggccgctgggaatcaccgctgtcacgccatggccggtattaggagctgcactcctgggaagcatcgggtgtcatctgctgtttccttccaggaaaaagagatggaaggaatggcacagagatgagccgtttgagtcagtcattgacgaggaggacggaactgctgtctgtcacagaactacattcggttctgccgtcaagtatgtaaattctgatcatttcaaatacgcacagtttgacgtaagcttcggagagatcaaggcttacttcgacaatgcaggagtagagggcggagatgccgaaatcaatgtggacgtatcgtttgcagggatggagctttttctgccgaaagagtggacggtgatcaatcaggccagcgctgtcttcggggctgtggatgagaaaaacaggaaccacggcgacggtacgatacggattagactgaccggaagaatcagctttgggggagtcacgatcatctatgtatgacatcttccacatgatttccgttcggctcttagaatgcctcactctaaccatgtaaaaatggacataatggctgccgaacaagtattgtcaagtaaattggacgcagtatctgccagagaaagcagatgaataaagaacactattacagaatggttcccttctgctgaaagaattccttctgccgcagatattatatggaaaatatcgtatgaaaacagctggttcatccggctgttttttgcgtttctcttcttgttttgtgttataattaataatatagtgtaaattggaaataagaacggaaatatttggagtgcagtaacgggggaaatgtgatgacaggaagagacactattttaatcgttgatgatatggagataaaccgtgtcatcctccgtggagtgtttgaagcagattacaattttcttgaggcagagaacagacaaagctgtcatgaacgtatggacggaggcagatgcatcgctgatccagtggggagaaaaagatgcatgtatgctgtcctgccatgatattaccaggtataaataacatagaaaggatgatgaaaaatggctgtaattggtgcatttatggtaccgcatcccccgttgatcgttcccgaggtgggatgcggaaaggagcaggcggtggcagacaccgtaaaagcttacagagaagccggaaaaaagatcgcctgtcttgccccggagacagtagtgatcgccacaccccactctgtcatgtatacggactactttcacatttctccgggagacggggcccggggggatttctcacagtttggagccgcagagagccggatctgtaccgactatgaccgggaaatgacagagctgatcacgaggctggcgaaagaagacggatttatggcaggcactgcgggagagcaggagaaacagctggatcacgcgtccatgattcctctctatttcatacagcagaattatcaggagtttcagactgtcaggatcggcctttcgggtctttctctttctgaccattatacaatggggcagtatgtgaaaaaggcggcagacagccttggaagaaagacagtttttattgccagcggagatttgtcccaccgactgatggaggacgggccttacggatactgtgaggaaggtccccggtatgacagcaggattatgaagactatggaaagcggaaattttctggagctttttgagtttgacgaggaatttcttgagaaagcaggagagtgcggccacaggacttttgtgatgctggccggagccctggacggcacggccgtgaaaacggaaaaactgtcttatgaggggccgtttggcgtgggatacggggtctgtgcctttgagccgctcagggaggatccggaccggaagtttaaggacgagtatttgaggcttcagagaaagaaggcggagcgaaggcaggccagagaagactgttttgtgcgtctggcgagactgtcactggagtcttatgtgagaaacgcaaccgccatcggagttccgaaagggcttccggaagaacttttgagcaaccgggcaggtgtctttgtctctctgaagaaagagggaaggctgagaggctgtatcggcactatttgtgcaacgaaatcttctgttgctgaggaaatcatacaaaacgcggtcagcgccggagccagagacccgagattctcccctgtcagggaggaagaactggatcagctggaatacagtgtggatgtcctcggaaagactgagaaggtaacatcaatggaggaactggatgcccaaaaatacggagtcatcgtaacacggggagggcggagagggcttttgctcccgaatctttccggtgtggatactgtggatgaacagattgagattgcaaaacaaaaagccgggatcggagaagaggaatctgtacagatcgagcggtttgaagtcataaggcacaggtgagaagatgaaagagacatgtacggtatgcatgcaccgctgcaggccgaaaccaggccagttcgggagatgcggggccaggaaaaatgtaaacggtatgatcgtgtgtgaaaactatggcaggattactgccctggctctggatcctatcgaaaagaaaccgctttccatgttttatcctgggagtgtcatactgtctgtgggaagcttcggatgcaacttaaactgtcctttctgccagaactatgacatttccatggagaatgcagatgaggcggagacggtctttctggcaccggagaagcttgcactcaaggcttcggaactcagggccagaggcaacatcggagtcgcatatacttacaacgaaccgctgacaggttatgaatatgtgagagatgcggcaaaaatagtaaaacagtacggaatgaaaaatgttctcgtgaccaatggcgccttttcagaagccgtggaagaatcgctgctcccttacattgatgcgatgaatgtggacttgaaaggcataagagaagaatattacaggaaattgggaggagatctgggcacggtacagaattttataaaaaaagcggcggacagatgtcatgtggaacttgcagcactgatcgttcccggagaaaatgatacgagggaagagatgaaggagatggccgcctgggtggcctctgtaaatccggaaattccgcttcacgtgaacaggttttttccgagatggaaaatggcggacaagaaggccacggaagccgaacaggtctaccggctggcagagacagcgagagcttatttgaaatatgtatttgtgggaaattgctaagagagaacagcgggacatggtccttgctgttctctcttgtgttcaggcattatatgccgcaatgctcacggcccccgtaatactgaaggcttttggggattccggatagctcacccggaaactcagggaagccgggctgtgcagggctttatctgtgataaaacaagccgatgccgatgcgatcccgtctgaggcggcaggggaaaaagaagcatataaaagcgcgggcttgctgttgatgcacggaaggatacgaaaatacttccagcttccgggaccggcaataaaatgatagctcacaaagtaaaacgaagacggcatcaatatggctgtatgttcatctgcctgtctgatctgtccgccctgttcaaagacctggaacatgggaaggagactttcggaggcagaatcggcatcaatactatattgggcacaggagggcagatggcttcccgggggttggcaggagacagtaaaatgattcaaaacatcacatccataatttgtctttctatattttatggtcccgggaaaaatgtgtgaaagaaaaaacgagggagaagatttttcatagaaaaaagtatattgtatacaggtaggaaggtcacgtattctatggtaaaataaaaaaaagatgtacagtttagaaaagaggtgcaagatggagcagaaaaatgaaatgaaatggaccattctgaaaagttctgcacaaggtttattggattgccttcattgttatacgaagagccagcttttagagattgcctctttttatggaatggacggcacacggtacaggaagcatgaactggcggagaaactggaagccgagattttagcccagatgcctgctgttttaaaatacagctcttctgaagacttgagaggactgaaactgcttttgagtgaaccggacgggccggatggggaaagcgccggcatctggacataccagaaaagaggctggctttttgtattcggtgaagacggcgggaggaagtttgttgtgccgcccggggtagaagcaaagatcgtaagatttttgtccaatgcaaaaaacaggaagacagtcgtccacaaccaggagttgtaccggtatgcaagagctctggctcatttgtacggcgtttatgaaaaaaaacagctgatgagggtgtgggaagagtttcacagcacaccgctcaagaaaggggagctttccagattcctgaaaattaccgaaaaagtctacggagattaccgtgtcgaagggcgctacgtgatctcctccaagatttcggataccagggtctgcttaaaccttatgaatgaggtgaaaaacctgccgtattacatacccgatcaggaggaaatccgtctgtattatgaagagtatgtggatgtagatgcacctgagtacaaggaactgagaaggttcctggagaaaaggaaacacaatcctctgtcgtttgcggagctgatgacagcgctggaagacaatctgctcttaggaggcggtgtctctcaaatgttcagtctgatgaaaaacgccggtatttttctgaatgagacacatgaaaaagaggaatttctggcctgctgcgcccgctggcagaaacgcacccggcagtggagatgccggggctttacgccagaagagatcatcgaagaataagaagtacagagccttctatggcctccgttgtctgatgcagcggaggccatatgatttgtcagttttattctgtgcgggaatttttcggtttgttttgcttttcttcagggaatcggcagaagtcagaaaggggcataggacgtccgaagagatagccctgtatgccttcgcgctgcagagctttgataatttcaaactgatcctgtgagatggaagaaaaatcggatatgacagacttttgattgcaacaggagcgaatagctttattccgccgattggagaaatgcgaacagccaataatgtgtttggaccgcatcctgccgattcagctcattgaaaaggtgggaaaagtctacaaagaacagtttgaggcacatggctgtcagtttattcttgggcaaaagtcatggatatacataagaatagtgaaggggcaattgacgcagttttttagaagatggaaccagactggactgtgatccggtgagtgtggcaggactctcaggagtctggtcaaatgctatgaagcaggcacaggcagcggttccatgtgtccgttgcagatttctttgttgtggatgagaaaggaaaatatttttatcagttatcttaaagttgtcttaaatatcagtttctgccagcctgtcttgatgttataatagaactatcaatggtacagttcagttacagcacttgattaaaaggttgatacaaagagaaattgaacagaaaaatagcaactattgatatgaaaacagtataacaaatgttaaaacagcagacaaaattaacagttagattatatgcatgtttatcaaaagacaacggggacactgacaaagaaagcaacagcattaccaaccagttacagatgttacgctataacgcaaaagaaaagggctttatagctttctgtaccgaacagggcgcttgccggaactgttcagatacagaagttcgtatgtatctatatctgcaacatagatcatttctgtgatatcatcgatttatttaaacacgatcgtcctcctctgcccccttttattcttaacctgtctttttatattcagctgcggcaaatactgtacttgtcattatacaacagattttgccgaattctcagtcgtttactgtaaaaaacgcgaaatatgcgttacattttgaacagactgatttaccttgacacatatatcctacatgtgtaagatatagatgatgttgatacctgaagatcaggaacaggaggtatttatgaaaaagacagggatttttatactcggagcggcagcggcacttggcattgccgcatatgctctctggaattattttggcacaggacgtccaggagatgtactttccgagtatgtttcgtgtattgagaaaaaagactatgggacgatgtatggactgttagataaaggcagtcaaaaggagatctcaaaaaaagagtttatacagagaaatcaaaagatctatcaggggataggggctaaaaatatgaaggttactgtggataaagattcagagggagataaggtttcctatcgcatgtccatggatacgatcgcaggcaggatttcttttgatcaccaggctcattttgagaaagagggaagagattaccgtctcaagtgggatgacagcttaatctttccggacatggaattcacagataaagttcgtgtcacgaaattaaaagggaaccgtggagcaatctacgaccgaaatgggaaaatgctggcgggaaaaggaaaagccgcatctgtgggactcgtgccggggaaaataaaagaccggaaagcttccatatccggtttggcgaaactgcttggcatgaaggaagaggatattgataagaagcttcatgcatcctgggttgcagaagattcttttgtaccggtaaagaaaatgacgtctgccggagaagcaaaaatagagaagaagctgttaaaaatacccggcgtgctggtgtcttcagaggacagcagagtatatccgtacgggaagaaggcatcacacctgaccggatatgtccaggagatcagtgcagaagagctggaaaaaaagaaagatcaggggtatgagcagggacagctggtggggaaaagcggccttgaagtattgtatgaagaacggctccatgagacggacggatataagatatcgatcctcaatgaggacggcagagagaagaaggtgcttgccgtaaaaagggaaaagaacggggaagatatttatacaactatcgatgcgagacttcaggaaaaaatttatgaccaatataaagacgataagagctgttccgtgatgatgaatccgaagacaggggaggtcctggccctggtcagcactccggcttacgacagtaatgactttgtgctggggattcctgcggatcagtgggaggaactgaacaaagacaaggcaaaaccgctctacaaccgtttccgccagaaatgggctccgggatcatcctttaagccggtggtggccgggatgggcatgaatacagggaaactgaagcccaatgaggatttcggatacagtgggctttcatggcagaaagacaacagctggggatcttacaaagtaacgaccctgcatacatatgagaatgcagtgcttgagaatgcactgatttattccgacaacatttattttgcgaaggcagcgttaaagatcggggccaaagactatgcggcacaggcaaaacatctcgggttcggccaggaactgccctttgacattaagatggcagtgtctcagttttcaaataatcaaaaaagcattgattcagaagtccagctggctgacagcgggtacggccagggccaggtgcttgtcaatccagtgcatctggcatcgatctattcggcctttgtcaacaagggcagcatggtacgtccatatctgctgtataagaagaaaccggagccagagtactggatgaaagacgcattttcagaaaaaacggcggagatcatcaaaaaagacctcatccaggtcattgaacacccggacggcaccggacacggagccaggactcccggcgtgaaactcgccggaaagaccgggaccgccgagattaaagcgagcaagagcgatacttccgggacagagcttggctggttcggggtttttactgccggaaagagagaaaaagagccatggcttttgatcaccatggcagaagatgtgaaagaacgcggaggcagcggatatgtcgtgaggaagactcttccggtgatcaaagcgaaagagaacgaataatctttaaggcagtctgagccgctttcttccccgatgcgccgtcgcggcctttgatcctcagggcaaagcagtaagtattatctttggttttcagaataccgatgaaccatccgtttatgtcatggccgtctatacatccagtcccggtttttccatacaggatgcggccggggccgcagttgagccggatggaatttcggactgctctggccgttttttcagagcagccgagccggttttgatcaaagtctctgagcagcatgacctgttctaagggggagatcttcagagaggactccagccagaaagaagtgattccgccggaaatatcctcattgccgtaccggatgcgtctgagtgtttttttcagtgctgtcttcccaagtctttgatccagggtctggaagtaccagttgaccgaggaggacatggcgctgtcaagagtctggtctttattccaggatgaaaatggatactgcttttggtcccaggcaatctcggatttgccgggggagatcacgccggcatccaatgcggccagggcgctgtatattttataggtggaatccggggagactctctgccggctcattttttcattgtatatgctgtactggtttttatttttatcatataggacaaaacagccctcattttcgggaaagaaagtagacagatccaccggaacgaatggccggtcaggtttcccggatacggagtccgccaataaattatgattctgaacgaaaggcgaaaacaggagccagaggatcagcaggagagaaaaacctgcaagctgcgttttctttgacggcctgcggtaggaggcgatggccgtgatgcgctgttttagctgggaatagctgcctccgatgcccgaggaaacgaaaaatatctcccgggaagacaggtatcctgcaaaattcaggatcgtgtggccgtaagaattccattcatgctgtcttatatgattcagcacggacgcatcacaggctatttcccggtctgttctcatttttttgagtgaatacaggacgaaagggtggaaccagtacagcacctttacgatacagcagatgaggctgccggcgagatcaccccgcttgtaatggctcagctcgtgatagaaaacataggaaagttcacgtttagaaaagaccgagagaaattttttcggaaatacgatgacagggaagaagatcccgaacgccatgggtgtatctgaagtctcggagagtacaaaacggatttttctgcggattcccaattcctctttacactggagaaaaaggcgctctgtatccatgtttttaacaaaggcgatagagcggccgaaacggtttaagcggacgcaatgatacaaaaagattattgtcatggcggcagcgccggcggcccagatccaaaacagggcagtaaagaccgggccggggacagctgctccggcggatacggcatagtctctgatttgtccggcagagcctgatgcggcggagacagtggaggtctgtacagcctgcctgggagcatttttcataaaactgctgacaaaagagcagagatctgctgatccgggcaaacggacgggaagaaagaaaaggagggcgcagaaacagtaaagataccaggtcatatgccggtactgcgccgtcagacagtgccgcagcagcttttgtcccgccaggatcacagggacgataagagcaagaaacaggcagtggaagagaaaattctccatcagcgcttggtacattttattcatcctccttgtcaagttccgtatccaaaatctcttttaattcacgaatctcccgggctgtcagccggtcttcttgtaagaaattcgatacaagtgaactgaaacagccgtcataaaagcggttgagaaaagaagctgtctcctgctttaagatctcttcctcctttaccaggggagtatagaaaaaggctctgccatgcttttcgtaggtcagggctctttttttgaccagtcttgagagaagggtctggacggtcttcggactccagtcattttgggcggccagaagctttgtcacctggggtgtgctgatcggcgcatgggcccacacggttttcatcactttgtattcggcatctgatatctggggaatcggtttcataggtcctctccttttaatcttacaaatgtagtatatgaaattatatcacaggattttataaaaagcaaagccggaaccatgcagcactatggttccagcttttttaagatgtttaaggttgtctgggccgcctgttttaaatcgttcagatcctcttccggcagccggtgaaaggactgcttcagatgattaataaaagcctgttttgctttctgtgtcatacatgtgcccttttgggaaagccggatgtagacatatctccggttttcctcatccatgtaccgctccaccagaccttcctttgccaggggagccactgcccgggtagtctgttcttttgacgatccgatatatttggacagcctggacatcgtaaggccgggtttaacttccagcgcaaataagacagacagctggctttttgtcagattcagctccttcatatccagggaactgaaaatcagtttccggcacagagggaatatttcaaacagagatacggcgatccccgttgattctgcctgattcatgttttatactctccttaatttttcttttatatttattccttgaacaaaaaaagctgtccaacgatcgttttttagcactattggaggaacgcattttaaagcgtgacggaaatagtgctaaaaacctcatatttatagtatagtgagttctttgataagtgtcaatcgttgacaaaaatcaagtattgaggtatgatgaaaagaaataccaggaaatgtaaaggaggtatccagaatgaaatacaagaagacgagcagcattatcagagagtatacagattcctattctaagctgtgtacggagagctgtacggttccgaaaaagctgtattcccaatacggtgtaaagaggggactgagagatgaaaacggtacgggcgtcctggcgggactcaccaatatttcatcgatccaggcgtatgaagagattgacgggaaaaaggtaccgtgcgacgggcggctcctgtaccggggctatgatattatcgacctcacaaagaattttgtgcaaaaccgcaggtttggttttgaggagactgcatatcttctgctgttcgggcagcttccagacgaaactaagctggcagaatttaaaaacgtcctttcactctgcaggacacttcccagaaattttacccgcgacgttatcatgaaagcggccaacgctgacattatgaactctttgacaaagagtgtgcttaatcttgcgtcctatgatccgaaggcggccgatatctcaatgccgaatgtacttcggcaaagcctgatgctgatcagcgtatttccgatgctggcagtctacggctaccatgcgtataatcattatgtaaaacaggagagtttttatatccaccggccggacgaaaggctttctgcagctgagaatattttgaggatgctccgtccggacatgaagtatacagaactggaagccaaggtactggacatcgcgcttgtgctgcatatggagcacggaggaggaaataactccgcatttacgacccatgtggtcacatccgcagggtctgatacatattccgtcatcgcggcagccttatcttctctgaaaggaccgaaacacggcggcgccaatatcaaggtcgtacagatgatgcatgatctcaggaagcatgtaaaagacgtcaaagacgaggatgaggtgaaggcatatttgctgaagctgctgaacagagaagctttcgataagaagggtctgatctacggcatgggacatgcggtgtattcgatctccgatccgagagcgctgatctttaagagctttgtggagaaacttgcgaaagaaaagggccgggatgatgactttgcactttattcgtcagtggaaaaactggcaactcaggccattgcggaggagaggaagatctacaaaggcgtcagcgccaacgtagacttttacagcggatttgtttacagcatgctggatattccgctggaattgttcacaccgatctttgccatggcgagaatcgtcggctggagcgcccacaggctggaggagcttgccaacgtggataagatcatacgccctgcctacaagagtgtggcaaaagaaaagaagtatattcctatgcaagagcgctgattttaatctcagcggggaacggctgctgccgcttcagaagaagaatcctgtgaagtttccagcttccgcatctgaataaattcatgacggccaaggaagaaggcggtgacagcggcaatcccgtcagcgatggggcctgcatacatgactccgtcgattccgaggaatacagggagcagcaggatcagagggagcaaaaacagtatctgcctggtgagggataagaacatccctttcaaggatttccctatggaactgaaaaagttggacacgataggctggagtccatttataaataccataaaaagataaatgcggaaatagcgctcggcaaagtgaaaataggccgcgcttccctctccgaaaatgctgacgatctgcctcgggatcagctgaaaacagataaatgcggcggagaaaatagcggttacggttatgatctcttttttcagggtgtcacgaacccggctgtacagctgtgctccgtagttgaagccaaggatgggctggcagccctgagcgatgccgatggcaaatgccatgacaaatgcattgacctttataatcactcccgcacatgcaagcggaatatcgcttccgtaggaggaaagggcaccgtagtatgccagagtgttgtttaaagcgatctgtacggccatcatggcaatctggttgaagaagctggcgatgccgatggacacaatgtccttaagattatccgccttgatcttcagacagtcttttgtgagcttcatggtccggaatcttgtgagatagacagcggccatgacacaggagacggcctggccgatgaccgtggccgcggctccacctgcgatgccccaatggaatccaaagataaacagagggtccaggcaggtgttgatgacggctcctgtcactatgacgaccatagagtatctggggctgccgtcggaccgaatcagattgcagaacccattggtggcgatcagaaacggaaatcccagtgcagtgatccttgtgtaggtcagggcatagggaaatacctgtttcgtggaaccgaaggcgatcaggatcggtttcaggaaaagaagggaaaaaatacttaaggcaagacccgagaggatcagaagagatatagaggtaccggcaaaactttttgccttttcgttttttcctctccccatgttgagattaaaattagaggcaccaccgatgccaatgagaagtgaaagggcgatgcagacattgacgaagggaaacgccacgttggttgccgcattgccgagcatgccgacaccctggccgatgaagatctggtccacaatattgtagagggagctcaccagcatggcgatcacgctcggcacggaatatttggcaatgagccggccggtgctctcaaaggccagcggattgtcctgaactgaatgctgctgttccataattcatatctctctttcttatctatgatatacaaagtctaacatatggtttccggcccgcgtgaggaattccagaaacagatgtttttcttcttcggtgaagccttcaagaatctttgagttccagcgcttcagggcgtctttgatgaccgggcagacgtcttttgctctttgggtcggatagatgttgtagcagcgtctgttgtccctgttctgcacccgaacaatataattttctttttccaggtgggcaagagcccttgtcacgttgctggcattgacattgaacgcggtcagcaggtcttcctgggcaatgcccggatcttcacagatttttaatatataaatgtgctggctgctgttaaaccccagatctttgaattctttatccagctgcattttcgtaaaccgggatatggtcgatatccattttaaaaagcctttcacttatctactcctttataacagttgcgtgcgcaataaatgataactttatgataccgctggaaaaaaagattgtcaaggcgtatgataatcgtaaggacgatgtatcaggcgaagaatttcgggaaaaatcaatgtaagatgaagtaagagaaagaaggatttttaaatggaaaagtttatttgtatcctggattcttttcgggggaccgcaagttccctcgaaatgtgccggatcatgagccgaaaaatttcagagatatatccggacagtgaagttattgccatccctgcggcagacggaggggagggcagtgtggatgtgtttatgaaggtttttggcggagtgagggtgcggattgaggcaaaagacaaaagggagcagactctgaacaggtggcacatttggaccaggggctgatgcatttttccgagagccgtttttacactgaagaacacatcgcgtttgcggtggagaatatcctgcgtcttgtcagggctttagaaaaacagggaggagagtcatgtttgtccagttaaacagcatcaaaatgtattataaaaggtacggcagcggaaggccgctgatcctgctgcacggcaatggggaagaccacactattttcagggaggtcataaaaccgctgtccaaaaattttacgctttatctgccggatgccagaggacatgggagaagctcgggcacagaggagtttcactatatggacatggcatccgatatggtccagtttatcaaaaagctcaggattgaaagtccggctttttatggattcagtgacggtgggatcgtggggcttctgctggcatccaaaaggccggggctcttgtcccatttgattataagcggagccaatatcaatccagaaggcctgaaagcagagctcaggattccgctgaagatttcttatttttggtcccgggacccgaaggtgaagttaatgctcacagaaccccatatttccagaagccagctaaagggcataaggacaaagaccctggtccttgccggaagcagggatctggtcaaagagagccagacgagagagatcgccaggctgattccaagagccaggctcaggatcttaaagggggagagccatgaaagctacgtggttcataacaaagcactggcaactattatcgaacatgaacttctgcgttagtattttatgatgccaaaggtcttgcaaagaaacgatggtgagcatatactaaaggaaccaaaattgatagtctgaaaagagaaatccaaaggaaagaggtaggaatatggaagaattaaagacactgaagatcggccttttggggtccgggactgtgggaaccggagtttataagctggtggagagccagagggaagagatgccccataaaatcggagccaatctctcggtggcaaagatccttgtgagggataagacaaaaaagagggacgggatcgaccagagcctgctcacagaccgttttgaagatattatagaagatgatgatatccggatcgtcgtggaagtgatgggagggattgaacctgccagaacctacataaatgccgcgttgaaagtgggaaagcatgtggtcactgccaacaaggacctgatcgcagagcatggaaaggaacttttggatgaagcttccgccaacggctgtgatctgctgttcgaggcggcagtggcaggaggcattccgatcctgcgtccgttaaagcagtgcctggcggggaaccatctgtccgaagtcatggggatcgtaaacggcaccacaaattttattctctccaagatgacacaggagggaatggaattttcggatgctctcatgcttgccacggaacttggatatgcagaggcagatcccacggcggatattgaagggtacgatgcggggcgcaaagttgccattatggcctctatcgcatttaattccagagttactttttcagatgtttatacggaagggattactaagattacgtccagagatatctcctatgccaaagagatgggctgtaccatcaagcttttgggtgtggccaagaacacgccggatggaatagaggtacgtgtccatccgatgctgattccaagcggccatccgctggcaaaggtagatgattcctttaatgcggtgtttgtccacggagacgcggtggatgatgctatgttttatggaagaggtgccggagaactgccgacggccagtgccatcatgggtgacgtgatcgatgtggcaaggaatatccggtttgactgctgtggaaggatcagctgtacctgttataaggacctgccgatcaagaagatcaatgagatcgagagtagatattttctgaggcttaaagttgaggacagggcaggagtgctcgcaaagatcgcggatacactcggcagatataatgtcagcatatcccaggtgattcagaaagacagcagagaagggacagccgagctggttgtcattaccgcaaaagtaaaagagcagaacttctcagacgcgctggctaccattgccgagatgcagacgacaaagaaagtttccagcgtcatccgggtatattaagtatccacggatgtctgtccggcttctctggcttcagccctggagtaaagaagcacgcctccgaccgtgatgagtcctcccagaacctgaaggacagcaggaagttcctgaagcaaaaagaccgcaaacacggatgcgaccacaggctcacacagcttagaggccgacacaaaggcaggagagaaaaatttcaggcaccagctgaagatgctgtggcccaataaagtagaaaaaatacttaacaaaagcccgacgactgccgctctttttccatgcccgaaaagcgaatatccctggaccagtaacgtaaacaccagagatatggagcagaatccgtatacgatatatgtatagctgaccgtggacatttccgtccgggcgatccttccgatcagtgtatataccgccacgaaaacggcagcggccagggcgagcatgtctccgtacaggctgccgtgggagccggcagagtcggaaaatgcgatcaggacgcttccggccagagtgaagataatgcttatgacagcagtgcgggacagatgtcccttcataaaaattgtgaagcccagggcaacccagatgacttccgtacaaacgatggccgtggagcttgcaacggtggtgtgggagagggattcaaaccagaatgtaaaatgcagggccaggaaaataccgctgaccgcacagagacagacggttttacggtctgtctgcctgagctcggcaagataacttttttttccgagcaccaccggtgtcatcagaagcaccgtccacagcaggcggtaagctgcggtcactgacgaaggagcataagaatatttgaccaaaattgcagaaagggatatcccgatgatcccgatgacgatcatggtcatcggatgtttttctaaaaatttcataataactctcttttctatcgtatttataaaatctagtataccacatctttacaccgttttaatgcccttaccctctaccttgacactaattttattttctctgtgataagctttttaatcataaaggaggatatgaagaatgaatacagttatttgtctgatcggtgtcacagcgctggcactgctttgtgtgaagtatgcactgcagcataaaacgataccgctcgtaaaaagcgtgaccagggaaagtattaaggataatttaaagcttgattttacgatcagtcctgaagatatgaagattctggatgcggtttccacctgtgaaggttcttacagagacagtgaccacattgacttttaaaatgatacgagtttttggtaagggaataattgagaatgactctcagttattctcttgctttttttgaaaagggtgatatgatgttggtagttagttaatactaaccatcgcgcggtgtaagaatgaagcaggtgtgacatgagagagaaaaccttatcagatttaatcgtagagcattgtgccccgactttggcgggaatgaaatgcggcagcctgtttaactaccgttatcaggaaaatgcggctgcaaggcaggaaatccgcagctggaatcaatggctgaatccatgcgggctatatctggaagcgctgaaatggagagaagagtcggtcttggtttatgtataccgaagaaaagacctggatcagagactccgggaggaaggaattgctgagctgctttttgatttcggttattccggaacagaggccggacactgtctgagccatttgaaaagcaggcttttggcagatgattttccccacgagattggtgtgtttctggattacccactgggggatgttcggggatttatagagaacagagggatgaactgccggttctgcggaatgtggaaggtttactgcgatcaatgtgaggcactgaaattatttaaaaaatataggaagtgtaaagaaatctactggaaattgtatcagcagggcaggggtattttgaagatgaccgttgcggcataagaaaggagttatcatggcaaaagtatacatagcattttggagcggcacaggcaacacaggaattatggcggaggccatcgcagagggagtcacggcggcaggcgggaccgcggaatttgtggatgtggaatcagtctctgcggacacactgaaagatgcaaaagcatttgcactcggctgcccttcaatgggagtagaacagctggaggaatcggcaatggagccatttgttgaggaagtagcagcctttgcttcaggaaagcagatcgcacttttcggttcctacggatggggtgacggagaatggatgcgggactggacagaccgtatgaaatctgcaggagcatctgttgtgggcggagagggactgatcgcccatgaaactccggatgacgatgcaaaagcggcctgcataagccttgggaaaaccctggtaaagctggcccaataaaaatgataacaagtgcgggagccggtttgactggctccattttaaacagaggaggctgcttatgagtgttgtgatcattggaggacacgaccggatggtctgtcagtataaaagaatctgcaaagaatataactgcaaagcaaaagtgtttactcagatgagtgcaaaactgggaaagcaggtggggagccctgacttagttgttctgttcaccaatacagtttcccataagatggtgaaatgtgccctctgcgaggcgaaaaggagcaaggccaaaatcgtccggtcgcacagcagcagtgaggcggcgctggaatcaatcttagaacagtgttcctgagaaaaggatgcagggagttgaagcggacttatccgcttcttttttttaatgaatccttacaagaagtataagtgttattcagaagtgttattttgtataataaggtcagaaagacaaccgagtcctatgactgtgagaaaggatacaaaatgaccgagaaaaaaatggaggtacagtctcttaaaaagtattatggaaaaaaagaaaatataacaaaggccctggctggaatcagttttcaggttgtggacgatgagtttattggtatcatgggaagcagcgggtcgcagcggccagggctctcttgttaagaccggaaattctgctggcagacgaacccacaggggcgcttgattctaaaaataatgctgtattatgcaagacttaaaaatgcgtgtacggacgatgtatttgaaaaagtttcacttccgcatatatgcggtgaagtgatacttgcagtcagggacaatggaatcggggtcaagccgtatgatctgccgtttatttttgataaaggatttacgggagatacaaattagaagaaaaagaattccacaggaatggggctttatctggcaaagcagacggcggacagcctggggatacagatcgaaatcccggaggattacacagaaggctttgaaattgtcttccggttctgcaaggttttaacgccaaaaatttctatactgaaacggtgtcatatcggtatttttccgaaaagccataataaaatgggatggattggaaaagccgcattcaagcccgatctcctcgatactcagggaggttgtggtcagcaatttttttgagcagcgaagtctctgtgttaagagatatttgtgaggcgtcaatccataaatttctttaaattttctcaaataataataatggctgagtcctgccatgtctgcaagaacttccagagagatatctttctcgtctaaatgccccttcatgtattctgcagtcttttcaatagaaagctccagatcactttttttcttttctctggatgtgatggccagtaaagccagcagtctgtgcagatagacggaagctacatgaggagaaggttccgtcttgtcatacagcatcaggatccgttcacagcaatgttcaatctcaggaataagatcggcagagctgatgacaaatccctgctgattcaacagcatatccgtataagcatggctggtgttgcctttaaaatgaaaccatctcatgcgcagatgatccccgctggcgtagtagcggtgtggtcttctgcagtctaaaagtatgatcattccagaatgtgctgttttagtctcaccttcgtattctattgtaagtgagcctgaatctaccagaataatctggtttacatccagcgaatttctgctcaaagagtattctccgtcacagtgatagatccctccgtgaggcgaataaaacagatagtctgccgtaaacgggtcaggttcataatagtagcgttctgagtctttcagtacaccgttctctccaatcatcgatttctccttaaagagcaattttttattattttctgacaatcctgcatagtgatttattgtacagattattgtacgatacaacatgtaaagagtcaaacatgattttgccggcatgttttatcataatcaaggagtggtgcagcaggagctgtactgcgctggtctcttgcagaaaaagacaatatattattatgaatgggaacacaatcttatgttaggaggatctgaaaatgaaaggaattcgtattggtttaatcggagcaggatggatgggaaaggcacatacaactgcattccacagcgcaaaaatgatattcggagatgatgtgccggtgtttgagatgatttctgatgtgaatgaggaacaagtaaagaacatggctgagtccttaggttacaaccgttatacaacagactggacggacatcgtaaaagatccggacattgatctggtagatgtggctacacccaacagcatgcactttgaaatggtgaaggctgccctggaaaacggaaagcatgtcttctgtgagaaaccgctgtccctgtccggagagcagtcacagattcttgcggacttggcagcagaaaagaatgtggtaaattactgtggattttcaaatcttatgaatcctgccaatcaatatgtaaaggatttagtgcagagcggcagactgggtaagatcatgaggattcatgcaacttatgatcaggatatgctgttagatccggaacagccgatcacctggagacatgtaaataaatttgccggatccggtgcgttgggagatctggcaagccatttgctttctgtatcccagatgatcttaggcgatattgaagaggtgaatgctgtgaactctattgtcataccagaacggccgcttccgggcaaaaacgaaatggccacggtggaaaatgatgatttgatcaccttccttgtaaaatacaaaaatggggccatcggagatatttctgcatcccgggttgccacaggcagaaagaattacttctattatgagatccagggaaccgaagggactgtggtttatgatttggagagaatgtgtgaagttcaggtttattttaaggcggatgcagataaggacaacgggcgtgactgcggtttccgcacagttcttttaaatccggagcacaagggattcaaatacttccagccggcaggagggatcgccatagcctttgatgatatgaagaccctgcaggcacatgagctgatgcaggccatgaacgggggcagctatgaggggagttttgccatgggggcaaaagtggacggagtcataagcgctgttctgaaatccgtaaagagcagacagtgggaatcatgctaaaggaggagaaacatgaagtttcaaaatgttaaattaggaatcgcaccgatcgggtggacaaacgacgatatgcctcagttagggggagacctgtcctttgagcagatggtctccgaggcttccctggcaggctttcagggcactgaagtgggaggaaagtttccaaccgatccaaaagcactcaacaaggctttaaaactgagaaatatggagatcgccagccagtggttttcttcctttctctgctctgaaccttacgaaaaaaatgaaaaagcatttatcaaacagctggactttctggaggcagtgggggcatcccgcatcaatgtctgcgaactgacaagatgtctgtttgcggaggagacctctatgtttggtgacaacaagccggaggccacagaacaggagtgggagctgctgtgccagggacttgacaggttgggaaggattgccacagaccgtgggtttaaactatgctttcaccatcatatggctacggtggtacagactacagcagagacaaaacggctgatggaccatacaaatccccgttatgtatttctctgctatgataccgggcatttcacgttctcggatgaggatccggtggaagctgcccggatgttcggtgacaggatcggacatgtgcacctgaaagatatccgcagggataaaatgaaacaggcatatgacgaaggcttcaagttcaggaaagcagtgctggaaggatgctttacgattccgggggacggatgtgtggattatgacggtgtgttttcggaacttcataaggcgggttacgagggctggttcatcgttgaggcagagcaggatccggcaaaggcaaatccatttgaatatgcagtcatggcaagaaactatatcagggagaagaccggtctgtaaggaggacaaaaagttatgagaaagatcaagtttggaattataggaattggaaatatgggatgtatgcgtatccgaaatcttcactgccgtattccgcagtcagaagtcatcgccgtatgtggtaggagggaggcgcaggtgaaagcggtccaggaggaattcggcattccttatggctacacagactatgacgagatgcttcaaaatccggaaatcgatgcggttttgatcgccacaggagcagacgcccacaaggatcaggttgtggctgcctgcaaggcaaagaagcatatcttttgtgaaaagccgctggcgaaaaaggtagaggactgtctggccattgaagaggcagtaaaacaaaattcagaaaagtgttttaccgtgggatttatgaggagatttgatccctcctatgcagaggcaaagaaaaagatcaaaaacggtgagatcgggacaccgatcttatttaagggggtcagcctggatccgtctacggtgctggacgctcatctggagggtgtgaaaaaaggaatttatgtaccgtggtttattgagatgggcagtcatgatacagatcttgcacggtggttcctcgacggagatcccgaggactgccatgcctttggcggtgcctatgtgtgcaaagggctggaagaatacgatgactatgacaatggattttctctgaccagaatggacaatgggacaactgcatacattcaggtgggaagaactgcgacctgcagccatgtggaatctgagattgtgggcacaaaaggcaccatccgcataaacagcgtgccgaggaaaaactatgtgtctgcctttacagagaaaggctatgtggaggaatgccaggaagactttatgaaccgctggggagatgcattctataatgaacttgagaactttgtggactgtgtagagaacggacgcagcccggagattacggcccatgacggtacgatgagccttaagttctgccagaaactgcatcaggcatatttggatgaaaaataaccgaaaatctggaaggagaagaagatgagtgataaaatgaatgcaatcgtatttaaagatttaggagaatttgaatatacacagagaccggtaccccaggtttcccatggagacgatgtacagatcaggatcctggccgccagcatctgcggtacagatgtacatattttgcgcaatccgcccggaatcaaggcaaatagggggatcatccttggacacgaatgtgtgggtgaggttacagagatcggcagtgatgtgatcgatttaaaagtgggcgaccacattattctggacaacaatgtgccgtgcggagtctgcacaccgtgccagacaggaaatagtaatctgtgtacgcatatgggatccatgggtgttcataaagatggagtcttcgcccagtatgccgtagcccctgaaaggcaaatggtgcggattccaaaagagatcccgttagagcaggcaatttttgcagaaccgctgaactgtgtcatgggcgcagtgaaaaagctgaaggtgatgccgggtgatacagcattggtgctgggaggcggaccgatcggattatattttacgacattgctgaaagcctgcggagcgggaaaggttcttgtatccgaggtatcggatttccgcacggagtatgcgaaagcccagggggcggaccgtgtgatcaatcctgcgaaagaggatttaaagacagaggtgctgagtgagacagaaggaaccggggcagatatcgttatagacgcagtgggaattctgatcaacgatgcgctctcagcagtcaaaagcggaggaagcattctgctctttggacagaacggggccgcaagacaggaaatctgccagaatgatattacggccaggggactcacagtttatggcaactttattggaaattacactctgaaaaatgtggcgaatcttttgtccagcagaaaagtagactttgtcaatatgatcacccataagcttcctcttgaagatttcgagacagggctgaaagccatgcaaaaaggggaagcattggaagtggtcctggacccgtttgccaacgcataagccagcgtataagaataaacgtttatggaggaaatatatggataaacagacgagggaaattgacaatagttttaaaaggatcccctggagagtgcgctttgcctacggttccggcgatgtggcaatcaatgtggtttatggaatgattggaagcctgctgacgatattttatacggattatgtgggtgtctcagtggcggccatcggtgtggtaatgctggtctcaaggctttttgacggatgctccgatatcattatgggttttgttgtggagcgaacacactcaaaatggggaaaatcaaggccgtgggtgctgtggatggcgctgccgtactctgtctccgtggtgcttttgttcaccgtgcccatgactacagatcttttgcagctggtatacatttttatcacgtataacctttgcaacaccgtatgcttcaccatgctgagtctgccttatggaagcctgtccgccatgatgaccagaaattccacagaacgtgatatgctgagcattgtaagaatggggatgtccccattcggtcggatcatggcagtgggctgctcgcttccgctggtaaagattatgggaaatgaccaggcagcctggatcaaaacaatttccatctgggcggtgatcgcgctgatcctgctgctgatctgctttatcaactgtaaggaaaatgtccatataccggcggcggaagaaaaaaaagataagcagcctgtcctgaaatctatgaagtatttactcacaaaccagtatttttgggcggtgctgattctgtggatgatgcagaatgttatttacagcctgacggggaccattctcccttattactgcaaatatatactttataatgacagctggatgtacagtgtgctgtatttcacagagacactggtgctcatgggagcgacctgtatctgtccccttcttctcagaaaatttggcaagaggaatatgtctctttttggggctgtccttgctctggcaggacagctggtattcttcatggatccggaaagcttttcgtggcttttgttcagctgtgtgatccgggctgtctgcctggcgccgttaaattctattatttttggaatgctgggtgatgtggtggaattcggacagtggaaacatcacgtgcgtcaggaaagcctgatctttgcatgtggttctgtggggacaaagatcggaaacgggcttgcagcagcagccatgacaagtctcctgggaatgtctggttacataagttcagctgcaggcagtactgtccagccgggttctgccctggcaatgattatgaacatttataagttcggtcctgttcttgtgtgggtgatcgtcatcgcagtactgtttctctataagctggacaaacgatatgataccattatgtcggacctggaaaaaagggaaaggcagggggaattatagtagatttataaaaatcggcgcgctgtccatagcaggcatggccataaaaaacaagggtccttgcagctgagatatatactcccaactgcaaggacccttgcgaatattggctattttatttcgtcagcatctgcatgatcttattgctgcgtgcgatgaattttgtcatctgatcggccgggagctgtttgttgctcaaaactgccaggtcataaagctgttcacagatgatcggtgtattctctgcgtccccgtgtttaaacaggtactgtaccagctggttgttggcatttaaggtcagagattccgctcctccgaacatggccgggtccatgcctgccattccgtacattttcatcatatcctgcatccggcggctctcctcggataaggtgatgactgcggatacatcttcatttttcagtttgtccacatggacatccagattttcctttccaagagtctttctgaataattccgtaagcgcagtcgtgatgtcggtgagatcttcttcggaatcctctttcagggcaccttccacatcggcgtcgatccgtttgaacgccaggttcggattctgctgttccagctgagagataaacgccgcatcaatgttgtgtttcaggatgacggcatccagaccctgttctttgaacatattgatatactggctctgctgtacttcgtccgtaatgtagtagatggttgtcttgtctttctcatcggcagggaccggagccaggtcactgagtgttaaatacttttgatccatgttcttgaacagaacgtagtctttgatcttttctccgaatttctggtccttgatatagccgaatttaatgaacgggctgatatcatcccaatatttttcataggtttcacggtcggtcttgcacatgccgctcagtttatccgcaaccttcttggaaatgtagtcggagatttttttcacaaagccgtcgttctggagagcgctccttgaaacattcagcggcaggtccggacagtcgatgacaccttttaagagcatcaggaattcagggatgacttccttgatgttgtcggcgatgaacacctggctgttgtaaagcttgatggttccttcgatggaatcatactccgtgttgatctgcgggaagtacaagattcccttcagattaaacggatagtccatatttaagtgaatccagaacagaggctctttgaaatccgcaaatactttatgataaaatgccttgtattcttcgtccgtgcagtcgttcgggtgtttcatccaaagcggatgagtatcgcttaaagataccgggcgcttattgatctttaccagatcttttgcgggagaaacctcgaccgtttctttttcgccgttttcattttccttttcttcggtctttgcatcctcatggatatgctcgacaaccacatcctcttcggtcagttctgattcgtcgatcgtctcatattcctgttctttattggcatcggtcaaaaagatttccacaggcatgaaagaacagtacttctgaatgacttcttcaactttggattcgttggcaaacatcaggctgtcttcatttaaaaacagtgtgatctgtgttccgacctgttcccggacgccgtcttcgatgtcatattctgtaccgccgtcgcactcccagtgtaccggaaccgcaccatctttgtaagagaggctgtcgatataaaccttatcggctaccataaatgcagaatagaatccaagaccgaaatgtccgatgatctggtcctgatctgtcttatccttatatttctctaaaaattctgtggctcctgagaacgcgatctgtgtgatgtattcttcgacttcctcagccgtcataccaaggccggtatcgataaacttcattgttttttctttagcatcaacgatgacctggatttcctctttgtgaccttccggaaattcatattcgcccatggaagccagtttccggagttttgtgatggcatcgcatccatttgagatcaattccctgacgaaaatatcatgatcggaatacagccattttttaataattggaaaaatgttctcactgttaattgaaaggttaccatgtttttgtgccatgatatacacactcctttgcattgcttttctattgacaggtttaattttcaattcttcggcaggacaagaatctgccgttctgcataatattgtagagccacagaaagggaaagtcaagagaaaattagcactcaattcatatgagtgctgataattctgccgtgaatagtccggattaatttgagccatcctaaaaagaaaaataattgaagggagggatttttgtggatacgatttgggaaaagactgtggatatgccttctttcccggcttttcaggggagaaaaaaagttgagactgcagtgatcggcgggggcatagccggaattttgacagcgtatctcctggcactggagggaagagaagttctcgttttggaggcagacagaatcggcagcggacagacaaaggggactacagcaaaaattacagtttcccatggtctgatctaccaaaagctgatccgtgaagtcggaagggaacaggcaaggcaatatgcactgatgaaccagactgcggtgagaaaatacagggaattgataaaggatcatcagatcgactgtgattttaaagaatgctcttcctatttatactccaattatcaggaagaggcgctgaaggaagaagtacacgcggcacagtcacttggccttccggctgattatacgtcacagacagaactccccttttccgtgaaaggggcagtcaggtatactggacaggccagatttcatccgctgaaatttttaaaagcagcggcggaagggctggagatttatgaacagacccttgtcacagatgtggagaggaacaaaattatcacggaccggggaatcgttgaggcggagaatatcgtctttacgacccattatcccatcatgaaccggcccggatattattttcttcgaatgcatcaggaacggagctacgttctggctctcacggggactgatcatatagaagatatgtatctgggagtcgatccaaacaacggcctgtcttttcggccttacggaccatatctcttattcggcggcggaggccacaggacgggtgagaatcttttgggagggcagtatcagatgcttgagtcaaatgcccgccagtactggggaaattgccgggtggaaagcgcctggtccgcacaggactgtatgaccattgattctattccttatattggatattactctttttcaaagacgggatggtatgtggcaacaggatttaagaagtgggggatgagttcttccatggcatctgctcttttgatcacagattatattatagaaaagaggaatgcctttgcccatgtattttcacctcagaggcttcatctgaaggcatcagccaaatcgctggcaaaagaggggatggtgactgccaggaactttgtactggagagaatgaagattccagatgaagaggcggcgcatcttaaaaagggacagggcggtgtgatcgaatacgaagggaaaaaggccggggcatatagagacgagaagggaattgtccacgtagtttctctgacctgtccgcatctaggatgcatcctccagtggaatccggaggaattaagctgggactgtccatgccatggttccagatttgactataaaggaaatttaattgacaatccagcaaaggaggatttaacacatgaaaaacccgaatgcatttcaggggacaaaaagaaagaagaattattttgagggctggtatttaaaacaccagaaaggggatcagatgttttcgatcataccagcttatcatattgaccgggaaggaaatgcattttcatcccttcaggtgatcacaaaggagcagtcatggtatttttcctggaaggctgaggctttctgcggatcgggacagaagtttcatgtagtcctggatacgggaagaggagaggggccggtaagcattttttctgagcggggcattcttctcaatatccatgaggaaggattaagccttgaggggaggatcatttataaaaatattcatccgctttcttctgatattatggggccgttccggcatgtgcccggaatgcagtgccgccatgggatcatcagtatgcggcatcagcttttcggagaagtcactttgaacggatataagatgaactttgaccaggggacaggatacattgaaaaggactggggcggatcttttccggatgcctacctctggtcccagagcatatttcccgacagcggaaagaacagcctgatgctggcggcggcaaaaataccgattgcaggccttcatttcgatggggtgcttgcggcgctgaatttatacggaaaggaatataagataggtacttacctgggcgctaaagtaaagacagactggaaatccaggatcatcatccgacagggggacttaaaactccgggcccagctcctctccggagacggaaatgagcttcttgcgccggaacacggggcaatggaccggaggatcaaggaaagtctgtgctgcagagtgagatatactttttgggaccagaaactgaaggtccttgatatgatcacggacaggggaagctttgaacagagtcagaaggagagaacatgaatctacgtgtcggtgagatcctaaagttttatgagaggcaggggaagccggcagaacaggaagagattctttctgccctccgggagatccaggaggtgctgggatgcatcccgaaagcggtgcaggaagaagcttccctgcggcttggggtcaagccgtcctttcttgccgcatttgtaaaaaagtatcctgaatttaaggaagtttcagaaaaatatgagatccaggtctgcaccggtccgtcctgcggggcaggaaaagcccttgaaatattgagggctgtggaagctgcagggaagcagaaagaacgggaacagggaatctccgttaaaattgtgaaaggcagatgtacccggcagtgcggcaaaggccccaatcttaagatcaatggggtccttcaccatcacatgacgccggaacaggcggccgagttaatccgcctcctttaagagtgcttccaggctttctgcgtcaaagaccggagcctgacaggcccgtccccggcagaggtagcaggatattttatccggaagcaccggatattctttcgtgaacggagcaatggcagccagcatatctttgtttcgctctgttttgaccagtacggttaagtcagtcatctgacgtctggagagcagttccaggaattcttcgggaaggctctctttttttgccgtgatgaccagctgtctggacggatgaaactgggaagacagcacggtcagggcataacagtaagcagaaggatggacagacagatctgcagaaaaataagaaaaagtctgatccatgcagtctctgtatatggaccttccggttatttcagataagatcgagagcacatggagggcagcggagttgccggaaggcagggcgccgtcatagagttctttcggtcttaagatcagtgcctcgctttcactggaatagaggaaaaacccgccgtgttcccggtcaaaaaacagagagatcatgaggtctgccgcctgaactgcctttttaaggtattcttccagaaaagtggagcgatagagggaaagcatggccagggaataaaaagcatagtcctccagctggccgtcataagccgcttcctcgccgcaccaccggagaaacaggcggccatcgttttttcttaaatgtttgtcaaggaaagattctgctttttgtgcggcataaaggaatgtctttcgtccgaagatccgggatgcttttgtgagagcagagatcatcaggcaattccaggaagtcagtatttttttgtctgtggaaagactggtccgcttctttcggtaaagataaagggcctccttcatctcttgtaagtcctccgggtcatccgggagaacagaatggttcagcagattcgggatgtttttgccttcaaaattgccgcggtccgtaatatcatagcggcggcagaaaaggctgcctttttcttctcccagaacgtgaaggatttcatcttgggtgaaagtgtagtacttcccttcttccccttcgctgtctgcatcctgactgcagtaaaagcctccatcgggatgagaaagttcttctaagacataggagacggccgcatcaacgatttcgggaaagagagaatttttacagcatgcataggcttccccatatgcctctaaaagaagtgcattgtcatacagcatcttctcaaaatggggcaccagccagcggtcatcagttgaatagcgggaaaagcctcctccgatatggtcaaagattcctccccgatacatacaaagaagtgtgtgctttgccataaacagactgtccttatcaccgcacagtttgtattggtgaatcagaaacagcagcactgccggagtcggaaatttgggcgctgtgccaaacccaccgttgactttgtcaaaggatgctttaagttctgccaaagcctgagccgggacatcttctgatagggaaacattttctgacggccttcgatttgtattcagctggtcagtgatctcatttccgatttttaaaaggcgttcccggtcctgtttccataagagagagattcggggcagcaggtccatgaggcctgtcagctggtatcgggaagtcttgggcagataagtggccgcaaaaaacggtttctggtcaggtgtcataaaaacagacatgggccagcctccggaaccggtcattgcctggcagacagacatatagacggaatcaatgtccgggcgttcttcccggtctactttaatagaaataaaatgcttgtttaaaagctctgctacctcatggtcttcgaaagattcctcctccattacatggcaccagtgacaggaggcatagccgatactcaaaaatacaggcttgtcttcagctctggcttttttaaaggctttgggaccccatggataccagcgcaccggattgtgtgcgtgctggagcagataaggtgatttttcatggattaaaaggtttggttcaaattttgacatataggctcctttccaaatggttatggctttagaatatgcagatcctttttgtttcatccggacatcaggttctgttataataaaaagaaatactgattgtaagacttttttcagaattgtattcaatgaaatctcagaattggatgatacactgtggttatcaagaaaaagaggaggaagactatggcacagcccaagattttagtagtagatgatgacagagagattgtaggagcgatcaaaaagcgcctggaactggaaggatacgatgtagttcccgcctataacggtcttgaggctctggatgtgctcgtggagcaggatatccagcttctgattattgacattatgatgccgggcatggacggactttctgctaccatgaagatccgggagagcaaaaacattccgatcatcatcctgtctgctaagacggaggagagcgataagatcttaggactttccatgggggcagacgattatgtcagcaaacctttccggccggatgagctgattgcaagggtaaaatcccagcttcgcagatatttacagctcggaagcaaagcagcagggccggaagataagaacaggctgatccttggtggactgacactggatctggacggtaagtgtatttatgtggacggggaaccggtgaaagtcacggctacagagtttaagatactgaatctcctgatgaggcatccaggcagagttttttccgccgaagaaatctatgaaagagtctgggaagaagcagcatatgcaacagaaaacacagtgatggttcatattcggaggattcgtgaaaagatcgagatcgatccgaagaacccaaaatatttaaaggtggtatggggaattggatacaaaatggaaaaaatggattaacagcggactgattgctgcggtgagcattgccatggtaggcggagtgctgttcggcatctatcagatgcataccatggataattataatgacggactggatttcacaacgatcaaaaaaggtgagcggatggaagactccgattactatgtgcacgccgtccagcggattttaaacaaatgggtgaaagagaataatctgatggaccagaattatgatgatgttgaatcagaactcccgtccaatcttgaaaacgagatttttgtaaaggcaaaacttacgatccagccttacggcaaaaaagctgtgacgaaagaatacggtgccgatgccaggacagtaagaaaacctgtatttaagaaaaagattgtgatcaacagaaacgatacgctggggtatggattgaatcccaacaaaagtataagagcaaaatatgcaagcaatgcaaatacggatgagacttataatgatgaatacgaagataatgttatgtcaccgtcggatttttacaatatcagcggaaactctatgaacaggggaagcctttccctgcctcagacattttttattgacgatgctaagcagcagagacttgagtctgcagtgatcgaagtcggtttctacgatggatattataatgcgctgaataaacattacaagacgtttccggatgtgaggaaagaactgatgatcaaactgtctatattattgggggcagaggttttggggctgcttgttctgtcagtgctgtttgcacttcagaaaagccgtgccaggttcttcaaaaatatagaccgcatctggtacgaagtgattctctgcgtcataggatttggcctgttcctggtcgcaggaacggtggcgactgcatccatcggtgcccttcggcaggaagaactgataccgatcatgacatttgcagggatcgtactgctgatgatcgggagcgtattctccatctgcctgcagacaacggtctggcgcctgaaggaagggacatttttagaacacacactttgtgtgggcacggcccggagatggtaccgcaggaacaggcagagacgggaggcggagaaagaagctctggagtttgcagaccgtctggccgtggaacggctttcaatctaccgaaaaggaaagtacctcatgcttgcaattttctttgcagggctgtttatgatcgactggtcgcctattctggcagtgatcgccctctgtgtgggtctccttggaatgaaatatctgggagaacattttgatgaggttgcgaggcagcagagggatcttggaaaactgatccggcagatcgagagaatctcggagggagatctgaaagccgatgcagacataccgaaggaatccctgtattataacgcgtcgaaacagctgagcaatatcggaagcggcctggacaaatcccttcaggaccagatgaaaggggagcgcatgaagatcgacctgatcacaaatgtatcccatgacctgaaaacgccgcttacgtcgatcatcagctatgtggaccttcttgcgagagacaggacactgtctccggaggcaagggattatgtgaccatactgaatcagaaaacggagagactgaaaaatacgattgctgatctgtttgaacttgcgaaatctaccagcggtgaggccaaggtcacattggagccgatggatctcaagaaactgatggaacagaccctcgaggatatgagtgatcagatcaaagagtccggttttaaagtgaagtttcagtgtgaagcagagcatacgaaatttaagggggatgtgaaccgtatgtaccgggtagtgcagaatatattggaaaatgcactgaagtattccctcaaaggtacaaggatttttgccacgatctcaaatcagggcagcagagtctgcctgacggtccagaatacttccggttatgagatgaactttactgaggaggagatcatggaacgcttttacagaggagaaaaatccaggaccagtgaagggaacggcctgggactctcgatcgcagacagctttactgcaaactgcgggggagaatttaagatcgggatcgacggagatcagtttaaggctatgatcctgtttccgattcttccgtaggacacaaagttttaaaagtaaggacaatgacagaagtgccattacatgctataataacttcattgaagaaaggaatttctatgatgagaagacgtattacatgcatgctgctggcactctgtcttttattatgcgggtgcaacattgacggcaaaaaggactatacaaaaacagaagatctggacgaagctacccttcagggcatggcaaaggatatcacaaaggagatgacactgaaacaaaagatcgggcagctctttatggtatctatgtattcactggatggttcgggcagcaagaaccagaccaaagtaaccggaacgatgaagaagaccatgaagaagtatcctgtgggagggatcgttctgttttcaaagaatgttaattccgaaaagcagttaaagcagctgatcaaagaccttcagagtgcttcccacataccgctgttcatagcggcagatgaggaaggaggcagcgtctcgcggatcgcctccaagcttccggatgcagtcagccagtatcctgacgccagggagatcggggagacttatacggaccggcagatcgcagagatggggaaggaacagagcagacagcttaaggccttcgggatcaatatgaatctggcgccggtggccgatgtgctctccaatcaaaacaacacggaggtcggaaatagggctttcggctctgatgccaaagaagtggctgctattgtaaagacgctggtaaaaaatatgcagaagcagcaaatttcagccacgttaaagcattttccgggaagcggcgatgcccttggagatacccacaggggagcggcggagaccaaacagtccatccaggagctgagaaaaaaagagtttcttccatttaaaagcggtatggaggcagacgcggatgccgtcatggtttcccatctgattctcaccaatgtgacggatgagaaagagccgtgcagtttaagccagcgggtgatatcggacattctgagagacgagcttgagtacgacgggctcattttaaccgacgccatgaatatgaattccatcacagacagctatacctcaggggaagcggcggtgaaagccataaaagcaggcgtgaacattgtcgttatgcctgaggatctgggacaggcattcaaggccgtaaagcgtgcggtgaaagatggaaagatcgaggaatccgtcattgacaaggccgtaagaaggatcttctataccaaactgaaacggggtgtgatacagccggataccattcttttagaggataaccaataatttttttggatgtcgaaaaataaaaatcagtgcgatagaagatattgcactggtattttatatgtgatactatttgtgaggaagcctccaaagcggggcaatgcagtgaaagcagaagaataaaggagataagacatggagaaacaggaattattatatgaaggaaaagcgaagaaagtatttacaacagaagatccggatttattaattgtcgactataaagatgatgcgacagcgttcaacggagagaaaaaaggaaccatcatcggaaaaggcgttgtaaataaccgcatgtccaactacatgttcaagatgctggaagaaaaaggtgttccgacacactatgtacaggaactcagcgaccgtgaaacagtcgtaaaaaaggtggagatcgtgcctttggaagtaatcgtccgcaacgtggctgcaggaagcttttccaagagactcgggatcgaggaaggctttgaactgttagagcctacccttgaattcagctacaaagatgataatcttggggacccattgatcaacgaatattttgcttatgccatcggtatctccaaccgcaaagaagtagaacgtatcactgagtatgcatttaaagtaaatgaggcattgatcgaggaattcaaaaagatcggcattaaactggttgactttaagatcgaattcggccgctataaagatgaagtcatcttagcagatgagatctctccggacacatgccgcctttgggatttagagacaaaccagaaattagacaaggaccgtttccgcagagatttaggagacgtggaagaggcatacgaagaagtatacagaagacttggtttataatttattcacagagaggcttgaaaatggacatagaacgttttgacaagttaggagaagagtgcggcgtcttcggagtctatgattttgacggcaatgacgtggcttctacgatttattatggtttatttgcgcttcagcaccggggacaggaaagctgcgggatcgcggtttccgataccaatggtccgaaaaggaaggtttcttccaggaagggtatgggactctgtaatgaagtctttacccaggagtctttaggcgaactgaaaggcgatatcggtgtcggccatgtgaggtattctactgcaggacagagctgtcccgagaatgcgcagccgctcgtattaaattatgtcaaaggtactctgggtctggcccacaacggtaatctgatcaatgcgctggagttaaggcatgaactggaatattccggagctatttttcagacgaccatagattctgaagtgatcgcttaccatattgccagggagagggtcaatacccacagtgtggaagacgcagtggcaaaggccatccgcaagataaagggcgcatactctcttgtggtgatgtctccgaggaagctcattggggcaagagatccatatggctttaagccgctctgcatcggaaagagagacaatgcctatatcctggcgtccgagacctgtgctctggacacggtaggcgctgagtttgtccgggatgtggagccgggtgagatcgttacgatcacaaaagacggcattcagtcggactgcagtatgtgccttccaaagggcgaagctgccagatgtgtctttgaatacatttattttgcgcggccggacagctgtatcgacggagtcagcgtgtaccagtcaagacttcaggcgggaaaatatctggcgatcgattcgccggtggatgcggacgtcgtcgtgggagtgccggaatccggcaatgccgctgcactgggctactctctggaatcggggatcccttatggaacagctttcgtgaagaatacttatgtgggacgaacatttatcaaaccgaagcagagcagccgggagtccagcgtgcaggttaagctgaatgtcttaaaagaatctgtaagaggaaagagagtcatcatgatcgacgactctatcgtccggggtacaaccagcgaccggatcatctccatgctcagagaggcgggagccagtgaggtccacgtaagaatcagttctccgccgttcttatggccgtgttattttgggaccgatgttcctgccagagagcagctgatagcgtataaccgaagtattgatgaaatttgtgatctgattggagcggacagcctgggatacttaaagactgagagattggaacagctctctgaggggctgtcgatctgcaaaggctgttttacgggagaatatccgatggaaccgccgaaggaagatatccgcggagattatgataaataaggagaagaattcatgaacaataaatatcagagccccttatccgaacgatatgccagtaaagagatgcagtatatcttttcaccggatatgaagttcaaaacatggaggaaactgtggatcgcactggccgaagtggaaaaggaactgggactttctattacacaggaacagatcgacgagctgaaagaacatgcggaagacattaactatgatgttgcaaaagagcgtgagaagttagtccgccatgatgtgatgtcccatgtttatgcctatggagagcagtgccctaatgctaaagggattatccatctgggagctacttcttgctatgttggagacaatactgacattatcatcatgacagaggcattaaagcttgtgaagaaaaagcttgtgaacgtgattgctgagctttccaagtttgctgtagaatacaaagaccttccgacccttggttttacgcatttccagcctgcacagccgacaacagtcggaaaacgggcaagcctctggctgatggatcttgtgtatgatctggaggatcttgaccatgttatcgataatatgcgtcttctcgggtccaagggaacgactgggactcaggcaagctttttggaactgtttgagggagaccacggcacgatcaaaaagatcgacggtatgattgctgaaaagatgggatttgacaagtgccagccggtatccggacagacctattcaagaaagatcgactccagagtactgaatatattaagcggcatcgcacagtctgcccataagttctccaatgatatccgcctcctccagcatttgaaggaggtagaggagccgtttgagaagaatcagatcggatcttccgctatggcatacaagagaaatccgatgagaagcgaacgtatggcttccctggctgactatgtgatctcagatgccatgaatcctgcgctggtagcttctacccagtggtttgagagaactctggatgactcagccaataagcgtctttctgtgccggaaggattccttgctattgacggcattctggatctgtacctgaatgtcgtggatggtctggtcgtttatcctaaggttattgaaagccgcctcatgaaagaacttccgtttatggcaacggaaaatatcatgatggacgcagtaaaagcaggcggagaccgccaggaacttcatgagaagatccgtgtacattctatggcggccgggaaaatagtcaaagaagaaggaaaagaaaacgacctgttggagagaatcgcgaacgatccttccttcggaatgacgatggaacagctggaagcgattatggaaccgaaaaatttcgtgggacgtgcaccgcagcagacagaggaatttgtcagtgaagttataaagccgatcctggatgaaaataaagaaatgctcggtatgacagccgagatcacggtatagtattcatatgacggaaagctccttttaaaaggggcttttctctgcttataggggatgataatgtattattttattgtaaatccaaatgcagggtccggcaatgactttgccagggggatggggtattcaaaagacccgaaagagaggctcaggagcattttagcagatgagaacggggccgtgatcaatgtgggaaacacttttgctcccgatgactccgggtgtttcctcgtcagctccgggataggatatgacgcacgggtgtgccatatggtcaatcacgcaaagacaaaaaagctgatgaaccggctccacatgggaaaactgacttatctggggatcggtcttcgcggcctgtttgcggctgaactgtttgcggtgcgcctggttcttgatgattccagagaagaaatatttcatgatgtgctgtttgcatcggtccataacctgccttatgagggcgggggcctgaaattttcaccggatgcccggccggatgacggttttctgaatctgtgtattgtggcaggcatatcaaaggcaaagatgattcgtctgctgtccaaagtaccagggggaaagcatattggctgtccgggtgtttacagcttccgctgccggaaggcagaattttttatggagaaacctcaattctttcatatggacggagaagtgcctgggcagttctgccacgtgacggcagggatcggttctgaagatttgaagattttgggctgaccggaggagtaaaaatgtcccggtctgtaaatcctaacagggacaatgatttacagagaggaagggatcagatggacaggatatactataacgggaatattctcacaatggaagacacccagacagagccggaggcggttttgatatcggacgggatcattgcattcacaggaagcctggaagaagcagtgagggctgcgcagcatccggagatgatagatcttaacgggaagaccctgatgccggcgtttatagacggacacagtcatatttctcttgtggcacagttttcacagtttgcagatttgtccggatgcgaaagcttttcagatatcaaaatgcgcctggctgcatttcagaaggaaaaaaagattggtgcaggcggggctgtcataggtgtggggtatgaccacaattttctggaagaaaagaagcacccggataaacatatattggatgaagtgtcagatcaagtacccgtatttgtcctgcatgcgtccgggcatatgggggttggaaattcagttttattaaaagagtcagggatcgacgcgtcgacaccgaatatggaaggctccagatttggcaggataccgggaactatggaaccggacgggtatgcggaagagacgaaggcactgaacctgcttctggctcaggtatatgcaaagattccaagggacccgaaagcacagatagagaaagcccaggaactttacctgtcctatggaattactacggttcaggacggtgcggcatccggacaggatgtggaggctttatttgaggctgcgaaagaggggctgctgaaagcagacgtggtttcttatgttctcgtcggtgaagaacctgaaaagctggagcgggaatatgcagagcttaaaaaaacatactggaatcacatgaaactgggcggacggaaagtgatcctggacggatctccacagggaaagaccgcgtggctgtcgaaaccctatgtgggagaagaaaagtaccggggatatccggcaatggaacgggagaaagtacagaaatatgtccgggatgccatagaaagcggtgtacagatcctcgctcactgcaacggagacgcggcttctcagcagtggatcgacagttttgaaaacgctatggaacagtgcggtgtctcaaaagacgatgatttgaggccggtcatgatccactgtcagacagtgcggaaagatcagcttctcaggatgaaaaacattggtatgatcccgtctatgtttgtagaccatgtttactactggggtgacattcatttaaagaatctgggagaagaaagggcagaagccataagtcctgccaagtctgcatttgagcaggggctttgtgtgaattttcatcaggatgcgccggtggttcctccggacatgctgcatacggtgtggtgtgcagcaagccgcatgacccgggaaggaaagagcctgggagaagaggagcgggtcagtgtctatgaggcgctgaaagccgtgacgatcaacggggcctatgcttattttgaagaagacaaaaaagggagtatagccgaaggaaaaattgcagaccttgtgatcctcgatcggaatccactgaaaacacctatctcagaactgaaagacatcaaggtgacggagacgttgaaggagggagagactgtgtaccggaaacgctaggtgttcctggcttttccggtactttttcttttgacgatgaacggctcaaactcaagttttgtcacgaagctcctcggcctgtttttcgtcttggattccctgtgtctcactatgatatccactgcctcccgccccttggcctcgatagagtgttccaccgttgtgagggagatccttcgcatgtctgccatgggaatgttgtcaaagccgcagacagaaaaatcgttcggaaccttgtacttcatatcaaaaagggcatctaagattcccagggcgaccatgtcgttgtaggccacaaatgcagtggaatctgttccctcggtaaggatttctttggtcaggttaaagccgcaggaatactccagcatgttcggggaaagggtgttgtactcaccggtcgacacagagcggcaggtgacattttccggatcaaagccatgctcatagaaggcttttttcagtccctcaaagcgcttggaccgggaacgctcgatcgtactcatgggcgttgaaacgtaggtgatttttcggtgtccgagagagagcaggtgctctgctaccagataagccggtttggtgctgctgacatggatggagtcaaacatgatgtcgtcatttttgtctccgatgttgatcacggggatatgtttggacatttcatttacatcctcaagccacgaagtcgggtacaggtagacgatgcccgccgcgtcaaaatcctggatcatattcaggtagaactgctcggtgttgggattcctcagagtaggggccgcgaaagtgacatatccgtagtcgtgagcgcgctctgtgatagaatggacaagaatcgaatagtagtgattggataagaaaggacacatgatgacaatcactttggaaagcccgaccaactgagcttccttctttttctttttttcatatccgagttcctttgccgcatttaaaactttgagccttgtttcctcagaaaaagatacattgttttttttgttcagaatcattgacactgcggactgggaaacatttgcatatcttgcgatatcttttgtagtaacctttttttttgaagccataaatcctcctaatcaaaaaaatatttattaattaatattcattaataaaaacgagatatattactaataaaataaaaaatattaattgcctgacaaaagcataacataaatggaatagaaaaaacagataaaacctaggttttttttgatgggtgaatttggtatacaataaccataaattttcggctattaataaaccataaaattattaataaattcactttaaatcgcataaacactggggtttaagagtttgacaaaccggggggatacatggttaaatgataccagagcaaaagtgcagcaattcattttaggaggaagataatatgagattttttttagacacagcaaatgtagaagacattaaaaaagcaaacgacatgggtgtgatctgcggagtaacaacaaatccgtcactgatcgctaaatccggaagacagtttgaagatgtcatcaaagaaatcacttctatcgtagacggagctatcagcggggaagtcaaagcgacgacaaccgatgcagaaggaatgatcaaagagggaagagaaatcgcaaagatccacccgaacatggtagttaaaattcctacaactatagaagggttaaaggctacaaaagtattatcttctgagggagttaagacaaacctgactctcgtatttaatccgacacaggcactgcttgcagcaagggcaggagctacatatgtttctccattcttaggaagattagatgacatttctcagaatggtctggatctgattgccgatattgttgagatttttgaggcaggcggaattgatacacagattatctgtgcaagtgtccgcaatccgatccacgtaatcgagtgtgcgaagatgggcgcagacatcgctaccgtaccttacaatgtcattgagcagatgatgaaccatcctctgacagaccagggaatcgcaaaattccaggcagactataaagcagtatttggagaataagaaaggttgggagaaaaaatgacagtggcagaattacaaaaaacagccaatgagatccgtaaagggatcataaaagcgacacacgctgcaaaatccggacatccgggcggatctttatcatccgcagacatgtttgcatatttatattttgaagagatgaacattgatccggaaaatcccaagatggaagacagagaccgtttcgtgctgtccaagggacatgtagcgccgggactttactccacacttgcagagagaggattcttccctaaagaagatttactcacactgcgccatattgattcttatttacagggacaccctgacatgaagaaaatccctggagtcgacatgtccagcggatctttgggacagggcatctccgcggcagtgggaatggctgtggctgcaaaattacagggaaaagactaccgcacttacaccctgcttggtgacggagagatccaggaaggacaggtatgggaagctgccatgagcgcagggttcagaaagcttgacaaccttgttgtcatcgtggacaacaacggccttcagatcgacggaaaagttgacgatgtgtgttcaccatatccgatcgatacaaaatttgaagcgttcaacttcaatgtgattaatatcgacggacataactttgacgagattgccgacgcactgaaaaaagcaaaagagtgcaaagggaaaccgacggctatcatcatgaagaccgtcaaaggaaagggagtttccttcatggaaaatcaggtcggatggcatggttctgctccgaatgacgaacaatgtgaacaggcattgaatgaattagagaaggtgggatgttaagatggcagatgtaaagaaaatcgcaaccagagaaagctatggaaatgccctggctgaattaggaaaagaaaatccaaacgtagtagtattagatgccgatctggcagctgctaccaagacaggcgtgtttaagaaggaatttccggagcgtcatattgactgcggtatcgcagagtgcaacatggtgggaatgggagcaggtcttgctgccagcggtatgatcccgtttgtcagcacatttgcaatgttcgccgcaggacgtgcatatgagcaggtaagaaacggtgtgggataccctcacttaaacgtaaaaatcggggctacccacggcggtatctccgttggagaagacggtgcgactcaccagtgctgcgaggatgtggcgttaatgcgcacaatccctgggatgacggtcatcgtgccttccgatgatgtggaagcaaaggcagttgtaaaggcagcagcagaacttgacggacctgtatatatgagattcgggcgtctggctgtgcctgtgatcaatgatacagcagactataagtttgagattggaaaaggtactgtgttaagagaaggtaccgatgtgaccattattgcaaacggactttgtgtaggtgagagtcttgaagctgctgagaagcttgctgctgacggaatcaatgcaaaagtcatcaacatggcaacggtaaagccgctggatgatgagctggtgatcgccgcagcaaaagagactggaaaagtggttacagtggaagaacactctgtgatcggaggactcggaagcgctgtatgcgatgtgctgagcgagaaagcaccgactccggtactgaaacttggggtacaggatgtattcggacattcaggaccggcagtggaactgatcaaagaattcggactggacagcgaaggaatttacaagagcgtgaaagcgtttgtatagaaaaaaatattttataggattgaaaaagagatctcagttgaggtctcttttttagttattcgaatagttattcgaaaagttctctgtgcaggatgtttgagttttttaccactatttccggcacgctttaaaatgcgttcctccaatagtgataaaaaactattgttagataattccatttgttcgatgagtacttatccagtagatattacgtctattttctacatgattggagtgaggcattctaagagccgaacgaaaatcatgtggaaaatgtcatacaactttcctcgatgaaggcaaaaaatctaccgcattaagatgtcctgactcaataatttgatgaaaattttctatgctatacttaaattatcaaaaaggaggtgtgaaaggatttcaattttattgaaaggagcctggaagagatgagacgttcaaaagataaattctataagagacaaatatttgactgcctcatggaaggaaaagtagttgcagccggggagattacacaggaagtcggcctttctgaaaaatctgtgagaaacaagctggatggaatgaatgaatttctattgcagaagaaatccagcgcaagccgagggaggaggtgttccatgtacacttcctgtcagaggatatcttattcttgtccattcaaatcctgtgttctaaattccttggtatttcagaagtagaacttaccctggagcaggtgaggaaatatgataataagctggttgaattcgtagacagaatgttaaaaatgattggggatgttctggaagtagacctgacatcggataagaaggtcaaagagagtttgatcgtgcatctccgccctacaattttcaggttaagatacggcactcctcaggacaatgccctgattgactttatcaaagaggagtataaaaatgtatttcgggccagctgggtgatcagtattttatttgaggaaagctatcatctccagattacagaagacgaaataggatacattgttttatataatcaggcggccatagaaaggaaaaagtttcaatatgatgcattagtgttcactgattccaatatggggcatgcacagctgatcaaagagagaatacggaagtttgtgccggaaatagggaaattagtgtttgtcagtacacacgactacaaaacagaggactattgggactatgatctgatcatttcgtcgaaggatatgaagacaaaggacaagagagttgcagtgattccgaatattttaaataaaaatggtattgttgggctgagaaatcatttggatgatatgaattctcagatgatcgagaatgaaaatcctttttctccggaactgatctttgcggaactgaaggttcagacaaaagaagaatgtttacaggttatgtgtgaggccatgaaaaaaaagggagtcgtaaaagatgatttttatggcaccgtcatggaacgggagagaaatacgacaacaacgataggaaatgggatcagccttccccatggctcgccgactgccgtcaatgagccaaaggtcgcggtggctttttttagaagaaccggtcatctgggatgatgagcagatacagattgtatttttgctggggtttaaaatgaacacgagagatgagatccaccgtatacagttattctacaaggaatatgtatccctgatcgatacggaggaaaagatcaagatgctcaggaacccggcttcataaaggaaattcagaaaagaactgaacagaaggtgtacccggcactgaaagaaaatatttgtatcgtaccggcacagcttggagaagactgcggtctgatcggagccgcatatctggcaatgcagaaagcaggcttataacatatgggttctgagagggtatgaaatatatccggagaatgatataataaaatcaaaaggtgtgggaggcagtttatatgaaagttttaaattacggttccttaaactatgattttgtatatcaggtagatcacatcacagaggcaggagaaacgcaggcatctgaaaaaagggaaaccttctgtggaggaaaagggctgaaccagtccatagcccttgcaaaagccggagcagaggtttttcagggcggaacggtcggcgctgacggacagatgcttctcgatgaactgaataaatacggggtggacacctcctttgtgcggaaaattgacggcgagaccggacatgcggtcatacaggtagacaggaatgcacaaaacgggattcttctattcggaggagcgaatgtgaggcagacaaagcatgagatgaatcaggctctggatgcattcggacagggagattttctgctgatccagaatgagattaatcttttagactatctcattgacagtgcatttgaccgggggcttcgcattgtctgcaacccttctccttataatcgaactcttgaacaatgtgacttttcaaaaatttctatttttatgctcaacgaagtagaaggttttcagatgacaggggaaagagagccggaaaaaatcctggatgtgatggcggagcggtttcctcaggcagaagccgtgctgactttaggggaaaaaggtgctgtttaccggaagggaactgtgaaggtcaggcaggactgtataccggctgatgtggcggacaccactgccgcaggagatacttttaccggctattttatcgcaggtattatagaagggatgagtcccggggacaacttgaaacggtgtgcgaaagcgtcatccataactgtatccagaaagggagcggcaccgtcaataccgacatcggatgaagtcgatattatttgaagtttctgaatattatcttatatggaaaaatatgttgtttttctttccttgccggagtataataatattaacacaaaagaaggaggaacagcgaatggacaacaatgaattactcatacagatagaaaagttactggattgcaaactagaaggaagattcgattcattagaaggaaggcttgattcattagaagaaaaattcgattcattagaaggaaggttcaactcactagaaggaaggttcaactcactagaaggaagattcaattcattagagctaaaagtgcagtccatagatgacaggctgatcgcagtggaggaggacctatcccctatcaagagaacctgcctccgtgtggagaacgagatcattccaaagctggatgccctctatgaggacaggattccgcatgcagagttcagcagattaagcgaccgagtggaaaaaaatacacatatgctgttagtgatgaaggacgtaatcatcaatcacagtggtgagatacagcacttaaaagaggtaaaataatctttggtacttatgacagcataaagcaaaacaccagctcaatttgaactggtgttttataatataaaaattatgcttcatgaaacagcggtctactctacggttacggattttgccaggtttcttggctggtctacgtcatttcctctgaagacggttacgtggtatgcaagcagctgcagtgccaccgtgacgccgaaggttccgaatctgtcatctacggcaggtacctggatcaggtcgtcatagacgccctcgtagtctgacatgtctttgtcggtcaccatgatcacatgggctccgcgggctttcacttcttctacattggccatgatcttaggaaggacatgatcctgtgttgcgatggcgatgatcggaacgccctcagttacaagagagatggttccgtgctttaactccccggcattgtatgcttcagagttgacataagaaatctctttgagcttgagtgagccctcactggcaatcgcatagtcaagactgcggcctaagaagaatgcagagaaggtatccttgattttttccgcgatatctttgatatagccatccattttcagaacttctgctaccgtggagatcgcctcctcaaattttgtacagtactctgataattctccttctgtaaatttaccgctcagttcagccaattttagggcgatcaggtagaaacctgcgcactgtacagagaatgcctttgtacttgcaacggcaatttccggaccggcatgcgtgtatagtacctggtcactttctcttgcaatgctggagccctttacattaacaatagaaattgtctttgcaccctgttcattggcaaggcgcagtgcggctaaagagtcggctgtctctccggactgggagacaatgaccactaatgtatgttcgtcaaggatcggatccatataccggaactcagaagaaagttctacggtgacaggaatccgtaccatggattcgatcagatggcgtccgaccaggcctgcatgcatcgctgtaccgcatgcagtcacaatgatccggttgatgcctttgaacagatcgtcagatatcccgtcggtggcaaagtctgcacggccgttgtggagtcttggcataacggtatttttcagtgcctccggctggtcatagatttctttctgcataaagtaatcatatccgcccttttgagcagcggtagtatcccagtcaacgtggagcatttttggtgcaacgatgttctgatccatatcatagagtatgattccgtcttttttcatgactacgatgtgctcttccggcactacaaaataatctttggagtactgaagcagtgccaccatatcagaggcgatgaaggcgccgtcgtctgtggaagtggctaccagcgggctggaattgcgcatacagtagatctcttcaggatgatcgctgaacatgatacagaaaccgtaagctccttcaagggcttcatcggcttttttcatcgcggcaaacggatctccgtcatacacggagtcaagataaagagccgcaatctcggtgtcagtctcagaaacaggagtccggccctgagctttgagggctaaagcaatctctttgtagttttcaataattccattgtggatcagtgtgatttttcctgccacatggggatgtgcgttggtggtagtaacccctccgtgagtagcccatcgtgtgtgtccgatcccgcatgttccgctgcggtcttctgatgacgctactttttcgcggagattggaaacctttccggctgttttaatgatcttagtggatgagccttcactgactgcgatccctgcactgtcatatccgcggtattcaagctgtgtcaggcctcctaccaagatatctgctgcctcgagttttccagtaaatccaataattccacacatgttgaaatctcctttttatttaattttatgcggacacaaagaaaacgtcgcttaaaatgaaaaagcgatgaagtgtcctctcattcaaatgttcttttgtgtggtttttatatctttggctgtacagtctttgttctgcaattactcacaggtttgctctgtacatcacgcgtccaaagccacgggaaagcatccgccgaatcttcgatcactttccacctcgttaaccttctgctcttcgttatctgttcgataagtcaggttccgtgccagaaggtgcatggcgcttaaaactgctctgctcctttcttcgatataaactagaaactttacaaaaaaccataagaaaagtttcctaaagcatcgtatcatggatacagaaaactgtcaatctgggcagagcatttaagaaatttttcacaattaaggtatagatactttggaatgacagtgttataatacactgtatgactttttgcaaataagaaatctccgagtttttcggagccttttttgaaagacagaatcaaagtaaggagagtatcatgaaatctttggtaaagaatatagtaagccagattgggaagtggatcgagaaggttcctgttctgtgcaatattgtgctggcatttggcatggcatttttattggaagttctcggacgccagacatttgaccagggagtattcgggtttgtcaatgacaggaccaagatgtttctgtacagcgcattcatcatttttgtcacttattctgtggtattgatcgttaagcggaggctgtttacctacattatagtgacattggtctggtcagtcatcgggatagtcaatttcctgatgctcagtgccagaaatactccattcacgtacgtggacgtcacactgatgaaatctgtacttccggtcatgaccaactattattcgccgtcagccatcatttttatgggtgcacttattttaatcgtattggtgctgctcgtagtaggatttctctatctgccgaaaaaacagaatctacaatataaaaggaatatccttgcggttgctgttatttttgcagcattcggagtgaccaccgtatatggattcaggagcaatatgctcacagacaggatcggcaacatccggatcgcctatggagattacgggacaccgtattgtttttcgattactgcgttgaaaaacgggattgataagccgtccaactattcggaagaaaagatcgaccagattgagcaaaagaccaagcaggcacaaaataagaaaaagggcagagtcaggaagccgaatatcatttttgtgcagctggagtcacactttgatatcacccaggtaaaaggagtgaagttcaatcaggacccgctcccgaatttccacaaatatatgaaggaatactcctccggacagctgagcatgccgtcttacggcgccgggactgccaattccgaatttgaagcgattacaggtatgaacctggaccatttcggagcggcggaatacccttacaagactgtgctgcagtcgacgaccacagagagcatggccacattgctgaaagaagacggatataccgcgcatgccatccacaacaacagcgccgccttctatgacagggatctggttttctcccagcttgggtttgacaccttcacctcaaaagaatgtatgaatatcaaaaaatggacagaaaatggatgggccaaggatactatactcacaggctgtattctgaacgctttggattccacaaagggacaagattatatttatactatttctgtccaggggcacggagattatcctaagacagagattattgaaaatccaaagatcaaggtgttgggcggaatcaaagatgaggctttaaagaacaaatatacctactatgccaatcaggtataccagatggatcagtttgtgggagacctggtgaatgcattgaaaaaacggggtgaagatacggttcttgtgatgtatggagaccatctcccgagtctggaggtagatgataaagatcttacctacgggaataaatatgagacaagctattttatctgggacaacatgggactgaaaaagaaggacggggtgatcgaagcttatcagctcggttccgatatcctcgccaagcttaacatcaaaaacggggtcatgaacagtttccatcagacccggcagggcacgaaaaattaccagaaggacatgaaggcactgcagtatgatatgctttacggcaagcagtatgtctgggatcaaaaaaatccatttcaggcaacggatatctcgtttggcattagaaaggtcaatgtgacaaaagcttatgagactgaaaacagcatatttatagaaggaaataacttcacaaacttctgtcaggtgtatgtggatgagacgaagatcaatacgacattccacaatgaacatctattggaagtgtccaaaaaggatctgaaaaagggagatgctttcacggtgaaaattgtaagcaaggctccgagaatcctgcagacatccggcgaatatgtctatcagggagtaaagcagcagtagggctttatttgacagaaatggcgtaaaatctgtattttcagtcgacaggtcggaaacgtcatggtataatgacttaatgtttgtataaaactacaacaaagataatgatattttaggaggatttgtaagaatgggattacaagttgaaaagttagacaataatatggtaaaagtgacgattgaggtagagcctgaaaaattagatgcagcgatcaaaaaagcatataataagaagaaatcacagttcagcgtacctggattcagaaaaggaaaagtacctcaaaacttcatcgaaaaagcatacggagtagaagttttttatgaagatgcggcgaatattttgattcctgaagcatacagtgaatcaatgaaagattctgatctggatattgtttccagaccggacatcgacgtggttcagttagaaaaaggaaaaccgtttattttcacagccgagatcgcggtcaaaccggaagtaactctcggagattataaaggactggaagtcgaagaaaagaaaatccgcgtaacaaaagaagaaattgaaaaacagctcaaaaaggaacaggaagcaaatgccagagaaattacagtagaagaccgcccggtcaaagacggagatatcactctgatcgattactcaggatctgttgatggtgaaaaattcgagggaggaacggcagaagatcagactctggttatcggatcaggtacctttatcgaaggttttgaagagcagctgatcggcaaaaatatcggcgatgaaatcgaagtcaatgttacgttcccggaacagtaccatgcaccggaactggcaggaaaaccggctgtttttgaagtgaagatcaaaggaattaaagaaaaagaacttccggaattagacgatgagtttgcatctgaagtttccgagtttgagactctggaagactacaagaaagaaatcaagaagaatatcaaggcacaaaaagaagaagctgccaagacagaaaaagaaaatgcattggttgaccaggcagtggagaatgcatccatggacatccctgatgccatgatcgaagaacaggtacagcagatggcagatgagttcgcacagaggctcagttaccagggacttaacatggaacagtaccttcagtatacaggaagcgatgcccagaagttcgcggaagagttaaagcctcaggcgttaaagagaatccagacccgtcttgtattagaggcgatcgctgcggcagaaagtatcgaagccagtgaagaagactttaagaaagaattagaaaaaatggctgatatgtatcaaatggaaacagaacagttagagaagatggtacagggaagccagaaggaacagatgatggatgatattgctgttcagaaggcagtagatttcctgatcagttcctgccagacaaaataattgacagatagaaaaccgggaggggtttaagatgagtttagtaccttatgtcattgaacaaacaagtcgcggggagcgttcttatgacatttattcccgcttattaaaagaaagaatcattttcctgggagaagaagtaactgatgtttctgcaagcctgattgtatcccagcttctttttctggaagcagaagacccggaaaaggatatcagcctgtatatcaacagtccggggggatctgtcacagcaggcatggcaatctatgacacgatgaatttcatcaaatgtgatgtatctacgatctgcatgggcatggcagccagcatgggctctttcctgcttgcagggggagcaaaaggaaagcgcatggcgctgcctaatgccgagatcatgatccaccagccgatgggcggagcccaggggcaggctacagagatccagattgctgcagaacatattttacagacgaagaagcgcttaaatcgcattttaagtgaaaatacaggaaaactattagaagtcatcgaacgggatacggaccgtgacaactggctgactgcagaggaagctgtggagtacggactgattgatgccgtctttgacaagaagagggaatcataattagaaagagcgaggtaattctatggtaaatcacagcgatgacaaaaagcagcttcgttgctctttttgcaataagacccaggatcaggtgagaaaactgattgcagggccgaaggcaaaaggcgtctatatatgtgatgaatgtattgaagtctgcgcggatatcattgccgaggaatttgagcagtatattgatgatgcagagatccatttaaataaaccaaaagaaataaaagcatttttggatgattatgtgatcgggcaggacgaggccaagaaagtgctgtctgtagcagtttataatcactacaagaggattcttctgggagattcctcagatattgatcttcagaagagcaatatcataatgctcgggccgacgggatcagggaaaacactgcttgcccagacactggcaaagatgctgaatgttccgtttgccatcgcagacgccacggcgctgaccgaagccggctacgtgggagaggatgtggagaacattctcttaaagatcatccaggcggcagactatgacatcgaacgggcacagtgcggtatcatttatattgatgagatcgataagatcacaagaaagtcagaaaacacctctatcaccagagacgtctccggtgaaggtgtgcagcaggctttattaaagatcattgagggaacggtagcctctgttccgcctcagggaggacggaagcatccgcaccaggagtttatacagattgatacaaccaatatcctgtttatttgcgggggagcttttgacggactggagaagatcattgaatccagaattggacagaagtctatcggattcaatgcagagatcggaaacggcaaaaaagaggatatcgggggactgctccagcaggtactgccggaagacttcgtgaaattcggactgatccctgagtttattggaagagttccggtgaatgtatccttaaatcctctggacagagaggcgcttgtgcgcatattgaaagagccgaagagtgcattggtgaaacagtaccagaagctgtttgaactggacggagtagacctggtattcgaggacggtgctctggaagcgattgcagagaaggctatggagagaaagacaggagccagggggttaagggccatcatggaaggtgtcatcatggacttaatgtatcaggtgccttctgacgagaaagtgtccaaatgcctgattacaagaggcgttgtggaatcttcggaagagccggtgatcgagaggtctgatgacagaacgaagagaacgtcaggcgttaaaaaaagaacgaagaagagtaatggtgagatagcataagacatccggcccaaagtcaacaaactgctttaatacaagaatttcttgctattgaggcagtttttttggcataaatgacgatatgataacgaaggagaagcagatgaaaaaagtattaccgatgcttgcgctgagggggaaatacatatatccgaattcggtgattcattttgatgtctcacggagtaaatcggtgcgtgcgatcgaggaagccatgcagaacgatcagatgatttttttagacaatcagatcgatccggcgatggaagatcccaaatcctacgatctctaccagatcgggacattggcgagaatccgccaggtagtaaaactgcctcaaaatattatccgggtttttgccgagggtatgttccgggctgaaattcttgaagtttgtgaggaagaaccgatatttcgggtagaagcggcctatcagcacacggagcagcaggaatttgaacaggatgagaaagaggcggtattccgcgctttgaaagaaagttttgaaaaatataccggggtttggaatcagatggaccccaatgtatacagttatattctcatgcagacggatctggaagtgtttgtggaccatctggcaacccatcttccattttctctgcagaacaaacagaagctcctggaagaaatggacttaaaaccgagatgtgagctgatgcttgtgcttctggaacaggaactgcgtttggcttatcttaggctggatatccaggagaaagtgaaagagaacatcgatgacaatcagcgtgaatatatgctgagagaacagctcaaggtgatccgggaagaacttggagagaccaatatcgcagacgaagccgatgagttcctgcgcaagctttctgaaatggaagcaggcgaagaagtgaaggacaagattaagaaagaaatctcccggtttcaggctatgggaaacagtgccgccgagagcgcggtgctcagaacttacattgagattatgctggatgtgccatgggaaaaactttccgaagattccatggatctggaggaagcagaaaatattctggaagaggatcactacggactgaaaaaggttaaggagcgggttctggaatatctggcggcaagggccatgagccagaaaaaggacgcggccatcctctgtcttgtgggacctccgggaacgggaaaaacatccatcgcaaggtcgattgccaaggcaacccacaaagaatatgtgagactatccctcggaggcgtcagagacgagtctgagattcgggggcacaggaagacttacgtgggagctatgccgggaaggatcgtggcagcgatccgtcaggccaaagtacgcaatcctctgatgctcctggatgaagtggataaggtgggaaaggaccagagaggagatacggcatcggcacttctggaagttctggatggagagcagaacgaacatttccgggatcattatctggaagtgccgctggatttaagtgatgtactgttcatcgccacggcaaatgatctgtccacgatccccaagccgcttttagacaggatggaggtcatagaagtttccagttactctgaaaacgagaaattccacattgccaaaaattatctggtaaaaaagcagatggaagccaacgggctgactccgaaggaaattgtctggaaggatgatgccctgagactgctgatcgccagttatacgagagaagcgggtgtgagaagccttgagagaaccattggaaatgtttcccgaaaggttacaaaggatatttatcaggggaagaagaaaaaggtgacggtgacgagaaaagcagtccgggattatctgggcacggcgccgtatgaactggaaaaagaaaacttgaaggacgaggtgggaatcgtgcacgggctggcatggactagtgtcggaggagtcatgctcaacgtggaagtaaacacaatgccggggaagggaaaatttatcgtcacagggtcccttggtgatgtgatgaaggaatcggcccaggccgcagtgagctatatccggagcaagagcggcaaatataagatcaaggatgatttctttgaaaaccacgatatccacatccatattccggaaggtgcagtacccaaagacggaccgtctgcggggatcaccatgacccttgccctcctctcggctatcacaggaagaaaagtccgggggactgtggcaatgaccggagaggtgacgatcaggggacaggtattggcaatcgggggactgaaagaaaaaatgctggcagcaaaacgcgcgggcatgacaaaagtactcgtgccaaaggccaatgaaaaggatgtcagggaatttgatacagagatcacagaaaatattgagatcgtatatgtaaagaagattgaggacgtcgtaagagaggctcttctttctgaacagacaaaaagatgagacagggaggcagctttcatgaactatcaggagacaatggaatttatcggacgtgcaaataagtttggaagtattttaggacttgacaatatcagggaattgttaaaccgtctcggaaatccccaggaccggctgaagatcgttcatatagcaggcaccaacggaaaaggttccaccctggcgtttcttgcgtctgtatttaaagaacagggttatgaagcaggacgatatgtgtctcctgcttctttctgctatgaagaaaagttccgtattaacgatgagattatcacaaaggaagatctctgcttttatatggagaaaataaaaaaaacagcggaggagatggtcagagacggaaaagagcatccgacagtcttcgagatggagactgccctgtcatttctttattttctcgataaaaaagtggacgcagtccttctggaaacaggacttgggggacgactggatgcaacgaatgtgataaagcatccgatctgtacagtcattgcgtcgatcagctatgaccatacccagtatctcggcagcactattcaggagatcgcaggtgagaaggcaggtatcttgaaaaaaggatgtcctgcagtttcttacgataatacttttgaggccagggaagtgatagagaaggccgcaggagaaaaaaatgtgtctctcatctttgcagaggcaagccgtcttgacgtcttatccgaaaacttaaagggcgcagaattttcttacgtctgcgcagatggaacagagtacccgaatatggaaatcggtatgcttggggagcaccagatctgtaatgccgcagtcgctctggagactatccaaatcttaaaaaaatcttatatttttcggcaggattccataagaaaaggattaaaaaatgctgtatgggatggccgattacagcgtatttgcgcggttcctgaggtttattgcgacggagctcataatccggacggagccgaaaagcttttacggttccttcaaaagaattttacaaataaaaaaataatctatataatgggagtattgtcggataaagattatttgcagatgttaaagattatgtctccaatgtcagatgaaatttacgcggtgacaccggaaggtgaccgtgccctgccttcgggggtgctggctgacgctgcccgtccgttttaccggaaagtgaccgaaggaggaagtcttggagaatgttatcagaaggttaagaaggaatgcggacaggacgatgttatcgtcgtgttcggaaccctgtcatttttaaaagaactgagaggttagagcagtgaagcggctttcatatatcacgaatcatccggaatatcagagtgcttaccggcagattcaggatgcggagaaaggaagggccttttgtctccacgacaccgggcattttctggcggtttccaggattgcttatatccttgtgcttgaagaacggcttgacgtaaagaaagatgtgatctatgccgcaggctttctgcacgatatcggaagaggaaagcagtattccgagggaattccacatgaggaggcaggcatttcgatcgcctcggctattttatctgagtctccttataatatagaggagcggagcacgattctgcttttattagggtcccacagaaggccggacagtgataagctttcctgcctttttggccgggcagacaagctctccagggactgcggcaactgtaaggcgagagaagaatgctactggccggaagagaagaaaaacaacatatatcggtattaggagctggatatgaagataggcaaaagacaatttgatataaaaaaccatggatatattatggggatactcaatgtgactccggactctttttcggatggaggaagatacacccgcctggatgcggctctgaagcatgcggagcaaatgctcggcgaaggggcggatatcattgatgtcggaggggaatccacccgcccgggacatgaaaagatcaccgcagatgaagagatcgagaggacagctccggtgattgaggccctgaaaagagagtttgatccggtcatttccctggatacatacaagtggcaggtggctaaggaaggcatccgtgcaggcgctgatatgattaatgacatatggggactcaagtgggacggaaaaatggctccgctgctggccagggaaggccttccggcctgccttatgcataaccggaagaatacagattacaaaaattttttgagtgatgtgataaaggatctcagggagactatgcagactgccgaggaggccggcatgcggaaagaacagatactgctggacccgggcattggatttgcaaagactttggaacaaaatttgatgctcatgaaccatttggaacttcttcttgagtttcaggtgccggtactgctcggtacatccagaaaatctatgattggatttactctggatctgccggcagatgagaggacagagggtactgtggccactacggtgagcggatatatgaaaggctgccggatgttccgggttcatgacgttaaggaaaacaggcgcgccctcactatgatcgaggcaatctgccgttattaaaggagcggggaagatggatcagattattataaaagagctggagatttactgcaatcacggcgtatataaagaagaaaaagtcctgggacagaaatttcttgtgtccgcagtactgtatacagatacaaaacgggccggcaagagtgataaaatagaatattccgtcaactacggggaagtatgccatcggattcgggagatcatggaaagaaatacctttgatctgatcgaacgggtggcggaaacaattgcagagcggcttcttaaggaatttgacttgataaagaagacagaggtggaagttaagaaaccgtgggctccgattggactgccgattcagagtgtttctgtaaaaatcgagaggcagtggcaccgggcgtatatcggaatcggttcaaatatgggggaccggatgcagtatataaacgaagcggtaaaacagatgaaacaggaagatgatctcaggatggcctgtatgtcagaccttgcggagacagaaccttacggatatacggagcaggataaatttatcaacggatgtatcggtatcgatacattgaagacgcctgaggaactcctcggatatttgcagagactggaaaacaatgcgggcagagaacggctcgtgcattggggccccaggacactggatctggatattttgctgtatgatgacatagtgattcatggggagcatttgaccatacctcatacagagattccgaaacggagttttgttttggagcctcttgcacagatagcaccttatgagaggcatccagttctgaacaaaaccatcctggagttaaaagatgctttggaggaaaaggaagaaaaatgagagatttacttgacataagaaaggacatagaccggattgaccgaaagatcgtccgcctgtttgaagagcggatgcattgttccgaagaggttgcggagtataaaaagggaacaggcaagccgatctatgacagggagagggaacagcagaagatagaggcactcaccggtgaagtcggaccggagtttttaaagaaggggacagaggaactctttttgcagctcatgtccatcgggcgcagataccagtatagtctcctgtcggaagaagacagttacgtgcgcaaaatgtttaaagaggtagataagctggagatcaaccgtgatacaaaagttgtatatcaggggattcccggagcgtatcaggaacaggccatggttcagtttttcggagagaatatcagccattttacggccgatgagtttaaagatgtggtcgtggcagtggatgagggaaaggcagattatggtatcctgcccatcgagaatacttccgcaggtactgtgagcggcatttatgatcttctcctgaatcatgacgtatgtgtagtcggagaagagacggtagagtgcaatcatgctcttgtaggcatcaggggaacagatctttccaaggtgaccaaggtatattcacatccacaggggctgatgcagtgcaaacaatttctggacgagaccggatgggatcaggtccgcataaggaatacggcggtggcggccaaaaaagttgctgatgacaatgacccgaccaaggttgcaatttccagcgagcgggcggcaaagctctatggactggaggtactgaagcgcaatgtgaattacgaaggaaataactgcacccgttttgtggtcatgtcaaagaaaaaacagtaccggggagatgccgggaaggtgagcatcagtttttctcttccgcatgagacgggatctctttataacattcttgcacattttatgttcaatgatgtcagcatgacgaatattgaatccaggccgcttccgaacaggcagtgggaatacggattttatatagatgtggccggaaacttaaatgaaccgggcatacgcaatgctctgaccggcatccgggcggaagtaaaagattttaaaatacttggaaatttttaaggagagagaggggcaggcttaaaaaaatacaaaattaggtgggaagaaaacatgaacagtaaatcaaatggtttcaaagacaaactaggaaaaattcataactttattcataagtttggaaaatattttatcattgtgtgtctgatcttattctgtgttctgtgtatcaagaataaagatcagttcgcggagcgggtggcaaaaggcgtgcctgaaagcggtatggaaaagatcccggttgcagatggagatacgatcacgcaggaattcaaagctaattttactatggcagaaaaattagaattccgtatagggagaaactttggtgatgcaaggcctggaaggattgaactgagtattaaggattccaaaggaaatattatttttcacgtaactccgaccatggaagaagtggatggaagagctgaaataaaagccacgatgagaagaagagaactggatgaagatcgttggtataaggcaatcgtaaaccagaaactagagaaaggcgaaacttatacttacgagatcaagggggtcggaattaagaaagatgatccgctgtatatttatacgtccagagatatgggatcaatttttgagccgctcataaaaaacggacagaaaacagagatccgtctttgtgcaaaaatgtggactactcaaattgatatgtgggccattggtctgacgattgcaattgcattaggattgatcgtgctcttgcttgtacagattaaaattcctgaaaagctgaataaatggatgtcatgggcattattcatcgtgaatccgtggctggctttttatatggtggaaaaagtattctacaatccgatcagcgttatgggagttttttcttatgcgctgaatatcatctggttctatgttatttttggaattctgcttttgatctttaacaggacaaaatacgcagtcattgtaggagatttacttttatacggatgtgccatcggtaactactttgttatgcagttccggggaactccgatcacaccggcagacatttgggcgttcggtaccgcgatggatgtggcagatcattatacattgtcttataataaagcagccattgttgcaacaatcatctgcctcgcactctgtatcattgcatggaaactggatactataaaagcattccgatggaaacagcggctgattgcactgattgtagtggcagcagttacaataggacagagctttctctgtacgagagtaaattttctggaatcaaaaaatgtaaaggtagaattcttcaatcagaaaaagggctataaaagaaatggctttgtgttaagtttcctcctgaatgtgcagtatctcctcggaacggaaccggaagggtacagtgtagataaggtaaaagacattgccaaaaattatgaggtgacaaccggacagaataaggctctgaagcaaaaaccaaatgtggtcgtcatcatgaacgagacattttctgatctgaatgtggtcaacaagatcaagacaaataaagaagtgatgccttatatcaattccatgaaagaaaatacgatcaagggcgatatgcttgtatcggtattcggaggaggaacaagcaactctgagtatgagttcctcacaggaaactcagtgtcttctcttccgctgaacggaaatgcctatacacagtttgtaaaacacgaagtgccgagtctcgccacccagttaaaagaacagggatatgacacgaccgcattccatccatataagccgaatgcatggaacagacagagcgtgtatccgctgctaggattcgagaacttcctggatgagtcatccttggatgaatccaaagtcaggagaatcagaggatgggtcagtgatgagtctgattacgataagatcatagagacgtttgagaatagaaaatcagataatcctctgtttatgtttaatgtaacgattcagaaccacggcggatatctgcttccggacgataacttcaagcaggaaattacgattgaagacgagaagaagacagagcctgcagagcgctatctgtctctgatccatgaatccgaccgggcatttaaaaagctgatcgattattttaaggatcaaaaagagccgaccatcgttgtgatgttcggggaccatcagccgaaactggaagatgagttttatgaacttctctacggaaaggacttaaacagtctgagcatcaaggagatgcagaagaaatttaccgttccgtttgtcatctgggcaaactatgatatcaaagaacaggaaaatgtaaagctcaccagtgtcaactatctgtccacgctgatgctcaagcagacaaatttaaaactgactccgtataatcagtatctggaagaactggagaaacagatcccggcgatcaatgccaacggatatgtgacaaaagacggtaaaaatgttgcgacccaggatgaggaagataaagataaatggctgacaaactatcagtatctgcagtacaattccctgctggattataaacaccgcgtagattccttcttttctgtgaaagaaaagtaggaatctccctgcggattcttgacacatgagacaaaacaatataatattaaaatgttgttcgctttatgcaaaagaaaatggcgaggacacgtcattgataattaggaggatacacatatggttaaagcaatagttggagctaactggggcgacgaaggaaaaggtaagatcacggatatgttaggtgagacttctgacattatcgtgcgtttccagggaggagcgaatgccgggcataccatcattaacgactacggaaagttcgcgcttcacacgctgccatccggtgtattctatgatcatacaaccagtattattggaaacggtgtggcactgaatatccctgtgctctttaaggagattggggaaatcgtctcccagggtgtgccaaagccgaatatcctcatttccgaccgtgcccagatcgttatgccgtaccatatcctgtttgatgaatacgaggaagaacgattggggaaagggtctttcggatctacaaagtcggggatcgcaccgttttattcagacaaatatgcaaagatcggcttccaggtcaacgagctgttcgacggaaaagcgttaaaagaaaaactgatcaggatctgtgagacgaaaaatgttttgcttgagcatctctaccacaaaccgcttctcaacccggatgagctgtatgaaacactgatggagtacaaggagatggtagcgccgtatgtctgcgacgtatccctgttccttcacaaagcgatgaaagaaaacaagaccattctcctggaaggccagctgggctcgttaaaggacccggaccacggtatttacccgatggtgacatcctcttctactttagcggcatacggagccatcggtgcaggtattccgccatacgagatcaagaagatcgtcaccgtagtcaaggcatactcaagtgccgtaggagcaggtgccttcgtcagtgagattttcggggaagaagccgatgagctcagaaaacgcggcggagacggcggcgaattcggggcaacgaccggacgtccgagaaggatgggatggttcgacaccgtggcttccaagtacggatgcaggatgcagggaacgacagacgtggcatttactgtgctcgatgtcctcggttatctagaagaaattccggtttgcgtcgcttatgatattgatggggaaataactaccgattttccgacaaccggtgatctggagaaagcaaaaccggtgatcgaagtacttccgggatggaagagtgacatccgcggaattacaaaatatgaggatctgccggaaaactgcagaaaatacgtagagttcgtcgaggagaagatcggatatccgattactctgatctccaacggacccggcagacatgagattatccgcagaggatacacagactaaaaatgaaaaacctctttgcagatacggcaaagaggttttttgcaaaggtataggagacatctatggaaaaagaacaggaacaagagaataagaaaaaacaaaacttcaggaaagaggtcagaagctggattgtctgtattgctgccactctggctattactttgtttatcacaaatttcgtcatagtcaatgccagtataccaagcggttccatggaaaataccatcatgaccggagataaacttattgcattcaggaccgcatacctgttcagtgagcctgaacggggggatgtgattatatttgagtatccggatgatgagtcggagtggtatattaagagagttatcgcgcttccgggagagacgatcgaggtaaaggacggaaaggtttatatcaacgggagtaaaaagcccctgaaggaaccttatatcaaagaggagcctgtggacgattttggaccgtataaagtgcccgggaacgggtactttgtcatgggagacaaccggaacagttccaatgacgccagagaatggcagacccactatgtgaccagggaagagatcataggaaaagcgagctttcgatattatccgtctccgaagtggatcaaataaaggagtgagaccatgaaaagaaaaattaggattcttatgctggcagcggcagttatgcttgctctggcagcgtccggatgtcaaaaaaaagctgaacgagagcaaaagccttttgtatcagaaaaagaactgaaagcattcataggagagacgaccaaaaaagacgaggtttcggactttccaaaactggactacgcttcggaccaaagggtgatgttccataattcccagggcttttatgtctttgacatgaaggaaaagaaagtcaccgcagctttggatctggtaaaaatgaaattattttccgaggatggagagaccgagacgaagattattgtatccggcgacggaaatgtggtacggcttttaagaacaaaaggggaagatacggttaaggactatttctatgatgtgaaggaacagactttgtctgaccaaaaacaggcctttgatgatgtctatgaaggagatattcagaagacaggtgaaaagaagtttgccggacactcgaaggaagaagtgatccgggagctgatggagcaaggacaaaatgactccaatgcgatgatccaaaatgaccgcaccgtagattttctcggttatccatccggggtatatatgaaggaagatcagatgtttaaaaatgtttctctgatccaatacgatgttaaagcaaaaaagaagtctgtgactcctctgtttgacggatttgtaaagaccgatcaggaaacggacgcctcaaagcttgtctttgaaggcagccgtttcatgaaattcagcgaaaacggagtcctctacttcgatgtggatgctatgcagaagaccggcgggacaaagggtacattcggagaccttgtcatcggaaatgtctttcagtcaaagagcggaaagcttacggtctcatttgaagatatttcaaaggcggatctttcgttgaaaccggtgctgtcactgaacaacatcgatgaaaaaggggaacctcagatgatggaattaaaagaaggcaggaatacttatacgttcagcggtctgaaaaaagaattattttattatattgactactatgcaacgaaagatgccccggatgaaaagagcatgaaaaagaccgatcagcaaaataaaaagctcagggtgagcataagcagctaaaagcatggacgcgggatacagtctgtgctataatattgatacaaaaaaattgtatgaacctaattattttttggaaagtgaggaagcaggtatgacatgtgaaaccatcaatgcacagaaagctcccgcagcagtgggaccgtactgccatgcggtaaaagcgagtgaatttgtgtttacttcaggacagcttgggctggacccggagaacggaactcttccggaaggagtggaagcccaggcggaccaggcgctgatcaacctggacgaagtgctgaaagcggcaggattatcgctggatgatgtgatcaagactaccgtatttttagacgatatcaatgattttgcggcaatcaatgcaatttatgagaagaggttcggagacaataaacctgcccgttcctgtgtggaagtggcggcactccccaaaggagccctttttgaaatagaagcgatcgcagctgttaaataacattatcaccgaagaaaacccgatttcctgtaaatgtgaattcaggacccgggtttttttattgctggtggagtgtagtaaaaaaatttcgatacaaaaggaatgaagatacgggagattgccggcaggatactccgggaagtgacggggaaagtccatatgaatatcaggagggatgcttatcgagcagtccctcttgattttaagaaactaagctttcatttcctcctccgcagggttgccctgttcagattctccgggagtatacacgagcagtttttttgacgtaaaataaaaaactccggtggtgacggcagaggccagaatatctgcaatcggttctgcggtgaagattcccgttgtgccaagaaataacggcaggatcaaggccagagggatcagcaggatgattttcctcagaagggccataacaagagaaatttttgccctgcccagtgccataaaagtattctggcaggcgtactgtgccccgataaacagaaagcctcccatgaaaatgcggatcatgggtctgccgagcacagaaagctgcctggccgcctcaccgctggaaaacagatatatatagatctggggaactgccatggagagggcccagattccaaaggtgtaggccacagtgataacaaataacagccgaaaggccttttttacccggtccatattccggcttccataattaaagctgatgatcggctgtgcaccctgggcgagtccaagggcgggcatggatagaaactgcatggcgcttatggcaatggtcgtgacggagaccagggagtctgcgctggcaccgccgtagcgtttcattcctgaatttaatgtgatctgtaccagactttccgtggactgcataataaacggcgcgattcccagggcgatgacagggagaagaacttttgcttccagcctgagatttttacggcggatcttcagatccgttttctttccggttaaaaaaccgaggacccaggccgcagagataccctgggaaatgacggtggctaaggcggagcccttgacaccgagacccattacaaaaataaagattgggtccagcacgatatttaagacagccccgatcagcactgtgagcatactggtcctggcaaatccctggcaggtgataaagctgttcaggccgagagaaaacatgacgaaaatggagccgagcagatagatgctcagatagtcattggcataaggcagtatattgtctgtcgctccaaatatggaaagcaggggttcttttgcaaggtaaaaaaacagggtaaggggaacggccagagcaatcaaagccgtgacggcattcccaagaatcttttctgccccgtcataatcctgctgtcccatttttattgagactctgggacttcctcccataccgatcatggaggcaaatgcagagataatcataatgatcggaaaagcaattccaagccctgcaatggcaagaggcccttctcctcccggaagacggccgatgtaaatgcggtccaccatattatacagcgcgtttatgatttgggcggcaatggtgggaacagccagctggaacagtaatttgcccacaggcatggttccaagggctgtttcgttgttcgtattcaaaaaatcactcctatcatatgaaaaatgtcactcttttattttacattgttttttcaatgggagcaattcttttattcaggaaaggtgtaggttatggacagtcagaaagggaagcaagagatcgtatatcaggtatatcctaaaagtttttgcgacggtaacggggatgggatcggagatttaagagggattctaaagcgtcttgattatcttaatgatctgggagtgactgtgctgtggatctgtccggtctatgcttcaccgatggaggatttggaaaaactcatatatgaggcggggatcagggggatgaaaataatgatggatctggtactcaaccatacatcggatgaacatctgtggtttcagaatgcgctgagggatcaaaaaagcagatacagggattattatatatttaagaaatcccgggaggggcgccctccgagcaatttaaggtctgttttcgggggatcggtatgggagcccgttgagggagcggaggagtattattttcattctttttcaaaaagacagccggatcttaactgggaaaatgaagacatgagaaaagaactgtatgaaatgatacggtggtggatggaaaggatggactgtccggctgttttccgtatacaaggaatgtaaaagggattgaagtttttttgggagaacttaaaaacgaagtatttgacccattagactgtatcactgtctcggaggccgtagatgtaccatattcatcgcttggggattatatcggggagcagggatgcttttctatgatgtttgatttcagttatacaaatttcgatctggaagggaaagatgagaaatggtataaaagaaaagcatggacagcagaagaattcagagagttactgtttaaaagccaggaagagattcagaagaccggatggccggcatgtatttctttttgaggggaaccccttttatttatcagggacaggaattaggaacaacaaatgtgtggaaagattctgtcagtgaatttgatgatattgagagcagggggcagtaccatgcagatgatataaaaaatttctatacttaagaagaaattcattcttttttaatctattccattaggatacaatgaaatagattgttactgttttgccagataaataattggaggtaattagaatgaaccagcggagcactgagattgtgcagttattaagtaaagagaaggatgagattacagtctcaggatttgcagaatattttcaggtgtctcagaaaaccatccgcaatgatctgaaggaaatcaatacaatcctgggtcaaaaccagcgggaggaagttgtgataaacagcgggggcaggatcaatccgccggagaattttaaggaatctctgtcattattgctcgaaggggacttctacagctataaattatccagggaagaacggaaacaggcagcatctgctatgatcgtaaattctaacgattacattacccttgcaaccatcgccgaccatttatttgtgagcagggcaacggtaatcaacgacctgaaagatatcaaggcatttataaaggaagggaacttgaaggtgatctctcacgccaataagggacttcgtatagaaggtccggagagcgaaaagagaaaatttcttttgaatctgcttcgtccgtctgtgtctatttatgagaaccataaaaatgtagttgctgaacatgtcagtgtacaggcaggtgactccagtgtaatacaaaagatcctgggggaacaggaacaacgctataagaaatatctggatgacagttcctttcaggagattgttctctatttaaggattatgataaatcgcaatcagtcgggcgaatttttggagacgcagccggatgaaaacagtgagaattatatgtttgccctggatacattaaaatatatctctcagtactgcgatgttgttacaacagaggatgatataaagtgtttcagcagcttcctggacggcgtgcggtatatgaaacataacacaattaataagaatacagtgattatccaaatgatcacaagacaatatattgccggtatttcctcggaattgggaatagatctgaatacagattatgagttttttgagaatctgtccaatcacctggaatccatattttctgcaccgccgatcgattaccaggaagttaatgtgataaatgaggtgctggaagataatcaggatgtacttgaggcggtcataaaccagatgtttgttatctaccaatatacagagcgcaaattaaatgaaatagaaataaagtatattgcgattcatgtgtgtgcggcgattgaacgaaagaagaataaggaagtggcttttcgtgtgatcgtagcctgtcatgcaggcatcggaacatccagactattactggaaaagctgaaaagacattttaaattccgggttgtggatgtagtctctgcccatgaagcaatgagtattgaacccaattcagctgattttgtgatttctacagttccgctggaaggctgttcgttagagtatgttgtagtatcggtagccttcaatgatgcagactacatacgtgtgggaaacagaattgatgcgctgagaaacggcagaaatcttccggtcagaatggaggaagatgggttaagtgcgaagggcctgatcgacgaggtccgtccccttgtatacagaatgattgagccggaagatagagcaaaggagtttatgaaggaactccgcggagtggtgcgggggtattttaaacagtctgtagagagtgaggcggagatcttgtccccatatctgcatcatttgctgcccgcagcaaacattgaggtggatgtagagtgtgaagactggaaagatgcagtgcgcaagtctggtgagaaacttgtagaacgaggctatattgaaccaagatatatagatgcaatgatccacagcatcgaggaatatggttcctatgttgtgttgtcggaaggatttgccatgccgcatgcgaaagtagaggaaggcagcatccgccttggtatgtatttcatccgtctaaagaatcccgtgccgttcggggtcgaaggactggaccccatagagtttgtatgctgtctgagcgccattgatcataagagttatttaaaggcatttttcagtctcgtaaatatgctgagggatgacgagtacaggcggcttctgcatgaggcaaagagctctgaggagattgcaagaatgattgaaacatatgaacacagcagtgtttaaataacaaaaaagcattggtcggatttatttctgggagaggaaataaattcgaccaatttattttatttccaggtccggaaatggattcgaccaaactaaaatttttcccggaaggggaaatacctttcactgtttttgattttatatgcatgatactatgtatttgtaaatgagagatgggaagccggccggcagatctcagcaacacaaatactaaagtaaaaagtggaggtacatatggaaatactattaaagttttttcagggatttgtaaatttgggggcaagtgttctgcttccggtcgtaatcgcaatattagctgttttctttggcatgaaagcaggacgggcgattaaagccggcttattggtaggaattggttttcaggggctttgtttagcggtaaatttactgattacttcagtgacaccggcgatggaatattatgaaaaattaggatcaggatatgacacattggaagttggatttgcagcactgggtgcagcatcatggaccacaccatttgcagttcttgtaattccgtcaattatccttgtcaatatcattttagtccgcttaaaggttacaaaggtattaaatgttgatatctggaatttcatgcattttcttgtgccgggagcactcgcatatgctttgtttggaaatgctgtcattggatttttagttgcttttgtctgcggtattattgttctgttttttgctcagtggactgcgaaaccctggcaggaattttttggactggaagggacaacatgtacatgcctgtctttcgtagcatgggcttatccgatcggctacggattaaataagatcatagacaaaattccgggacttaacaagattgatataaatatggataaggtgggacaaaagcttggagtgtttggcgatcctgcaatcattggtgttgtagtaggagcttttcttgcaatcattacaaagcaaagtcctggagaaactctcacaatggcaatgggtgttgcggcagctatggtattgatcccaagaatggtatccatcatgatggaaggattatctccgctgggacagtccgcaaatgaatatatgcataaaaaaatcggagaagatgcagatatttatattggtatggatattgcacttggtttaggtgatccaacttgtattacatgtactgcgattatgattccgattaccatactgcttgtatttcttgtaccggatatgagattctttccacttggattattagctgagatctgttatttggcacctatggtcgttttgagcagcaagggaaatctatttcgctcactgattgcaatgactattttgatgtacataactctgtttttggcgaatatgtttattccggaagccacaagcatgatgtctgttacgaatgtagattttggaaaaagtgtcacggcatctcattttggatggaatcccggcaatgtagttgtatcaattattcatagaattatggcgatgttcgtatgagggggctctaaatgaaaactagatatttggtaattcacgggacagcagctaatagtgaagaagcaattaaattatgtggagatgccttatataaagcaggtattgttgaaaaaaattttggagttctttgtgcccaacgtgaaaaagatttcccaacagggcttcctacagaaattccaacagccattcctcatgtaaaagatgaagggattacacagaacgcaatctgtctgctgaaactcaactgtccggtaaccttcaaacgactggacgatgatacagaagaagtgaaaacagatatgattttcaatctggcgatcaaagatgccaatgaacacttagcagtgctgcaaaaaatgatggcatttttgaatgatccggaagtcttattaaaatgtaaaaaactttcaaataaagaaacggaggcttatcttcaggaaaaattaggatcataattaatcacagtaaaggagaagaattatggcaaaagaagtgaaagtattagtagcatgcggcagcggtgtggcaacgtcaaccattgcccaggaagaaatcaaagagattgcaaaaaatgcaggggtgaagatcagattggtgaaagggacgattgcagaagttcccatcaaacaaaaagacgtagatgtagtttttactactgccaattaccgaaatccgcttgaaaagccgcatctcagtgtgtttgggcttgtctccggactgaataaggaagcatcaaaaaagaaagttgaagaattgcttaaaacgatttcagaagagttataaaagcccgaatatgtgaaaggatcaggtggttatagatgaaagcaggagttttactcgcaagagatgacataagatatgaggaagtacagaccccggagccaaaagccggggaagtgcttgtaaaagtaaaatattccgggatctgcggttcagatgtaccccgggtaaatgaagacggagcccacttctatccgatcattctcggacatgagttctcagggattgtggaagctgtgggagatggagtgacaaaggtaaagaaaggccagcgggtcgccggagctccattggtcccgtgcatgaaatgtgaagactgtatgaaaggtgattatgcactctgtaaagactatagttttatcgggacaagacaagcaggaagctatgcagaatatatctgtcttccggagcaaaacgtggttccttttaaggatacagtatcctttgaacaaggagcgctgtttgaaccggcggcagttgcgctccatggattagagtgtcttccatatgagggaggaaagactgttgctgtgctgggcggaggaacgatcggactgcttgtcatgcagtgggcaaatattttcggatctgcaaagactgttgtatttgatattgacgatgaaaaaattgaactggcaaaacagttgggagcagccgatggcgtaaataccttaaaagaaggttttatggaaaaggccatggaactgacggatcaaaaaggctacgattatatttttgaaacggcaggaagtactgtgacaatgaagatggcatatgaactggcggcaaataaggctggaatctgctatatcggaaaacctacaagagaattaacctttactgtgaaagaatgggagaacatgaaccgtaaagagttcactatgacagggtcctggctatcttattctgctccgtttccgggacatgagtgggagtgtgcggcacactattttgcaacaggacaattaaagggggaagaatccctgatctataagaagcttccgctttccaggatcgcagaaggatttgagatgttcaagacccggggagcagtaaaaggaaagattttaattgacagtgaagcatgatcataaggcgtctgaagagataaaagaaagaggtttgaccgtgagaaaaataaaactatctccatccatctttgcagcagacttaggagaattaaaaaaccagatcaaagaattagaagacagtcagacagaactgctccatgtggacgtgatggacggacattttgtggagcggatggcatttggagcagatcacattaaggcactgaaatcaatgaccgacattccgctggatgttcatttaatgatcgaacatccggaagtacatattgacagcattgctgacgcaggggcagatatcataacgatccatcaggagtcgaccgcaagggtgttaagctgtctgcataaaatccgtaaccggggcatcaaggccggcatcgtgctgagtccagggacgccggaagagactattaaatatttattggatgatgtagatatgatccttctgatgagtgtaaatcccggggaaggcggacagcatttcctgagttcaaccgtgaagaaaattaagaatgtccgggcaatgatcggagaccggaatattgatattgaagtagacggaagtattgatcaaaagacaataaaaccatgttatgaagcaggagcaaatgtttttgtatccgggggatatttattcaaaaatattaaagagaatacagaggctttaagaaaggcagtgagaggatgaaagctttaacattttatgatgtacaggatttaagatatgaagaggttcctgatcctaaaattgaaaaagacgatgatgttattgtaaaagtgaaagtaggcggaatttgtggttcggatatcgcaagataccgcaatctgggaccttatgtaaaagggaatgtctgggggcacgaattttcaggagaggttgtagaggccggtcctgccgttacagaattaaaagtcggtgaccgggtggtaggatgcccaaacctggtttgtcatgaatgtgagtactgcaaaagcggatatccatcaagatgtgaatctttaaataccattggagcatatgttccgggtgcatttgcagaatacattaaaatgccggccgtcaatcttgtcaagatggtggaaggtatgacctttgagcagggtgcattggtagaaccggcaacggttgcgattcacggattatatcagacaaacattaaaatgggatatgaagttgccgttgtgggatgtggaaatattggactgatggcaatccaatgggccaaagcatttggggcaaagaaagtgtttgccattgacatcgatgatgcgcaattacaggctgctgaggattttggcgctgatgtgctaattaattctgctgatatcgatttccatgatgagatcagaaaatatggaaatggcgtggatctggccattgaatcagcaggaaatccttttactgctgcaagagtgctcgggctgccgaaaaagggcggggaggttgtatacatgggaattccatatgcggatgttccggttccaagattttattttgaaagaattatgagaaacgaattaaatatcatcggttcctggtgtaccatttctgctccatatccgggagaggaatggaacaatgcggtagaatatatcggaaacaaaaaggtggatgttcttggaatggttacgcataaagtgaatttaagcaaaggcccggagatgtttgaaaagatcattgccgatccaaagggattcggaaaagttctgttatatccggaagaaatcatgtaaagaaggtggtattttgggaacgaaagtaattataaaagaattagaacaatcagctgacagaattcctgaatatcagatttcagatctgatccagaagattaagtctcataaacggatctttgtttatgggaccggaagatcaggattaatgttaaaagcccttgctatgagactaatgcagattggcctggatgcatatgtagtgggagaaaccacaacaccgtctgtagaaaagggagatttgctgatcgtggcttctgcttcaggagaaacaggcagtgtttgtatgacggcacagtcggcaaagaatcagggtgcagatttagtcgtcatttcttcagcagcggaatcgaccttgaaaaagatccagacaccgaatatcacaattgaatctgcaacaaaatttgctgtgtctgacacaagcatccagcctctgggcagtttgttcgaacagatgctgctcatagtgtttgatgcggcagtattggaaataagccgggaaaagccgggaagtaatgacgatatggcaaagagacacgcaagtctggagtagcttgtgacagaaatctttcattctataggaaagacattgttacaacaaagtgataaaggaatgattcctatagaataaaaaaccctccgggggatgcaattgcgtgcacaggggaacaatgtcgccagagcgaccgcacgcagtgcgagagtttcgcaagcgaaactctatttcagaaaaacaaggagaatagaaatgcagaataatatcgggttacaaacagcatattggaatggaacaactcctgaattggatatttataaaataattgacttaacaaaaaaagccaatatggataccattgaactgaaagcaggcgattttgttcctttgacggcacaagacagagggaaacttagtaaatatataaaagatgcagggctttcagtgacgatcaacgggactggactcagaccggaaagagatgtttccagttcggataaagaatcccatcaagcaggcatcaaacatttatgtcatatgttggatctttgtgtggagatgggcgcaaaacttttttccggtatcccgtatggtttgtggaatacacgtccggaaggagaaaatattacagaaatcaagaaggtccgtacagcaaacgcagtcaaaggattaaccgaagttgcaaaacatgcccaaaaagtcggcgtaacaatttgtttggaaattgtaaaccgttttgaacagtatacagcgaatactgcaggagaagggattgcaatctgcgaagcaattggcaatgactattgtaagcttcttttagatacgtttcatatgaacattgaagaagattatattccggatgccatccgtacggcctatgaaaagggatatctgggctatctccatattggagaaagcaaccgtaagattcctgccggagagagaaagaccaatattgactgggtagctattgcagaaacgatcagagagatcggttttgaaggacctttggtaatggaaccattcgttctcgatacgtccgcaagtgctaagagtgtatccctttggagaacgatcaaagcagcagatgatattgacggacttgtggcagatgccgccgcgggagtgaaatatttaaaaagtctgtaatgatgggaggggaagagcatgattacaactgtaacgttaaatgcttccattgataaagcctatcatatgacccaaaaaattgagaacggtacggtaatgcgagtagcagagacacataacagtgccggcggaaaggggctgaatgtggcaagggtggtcaaactttgcggttctgatacaaaagccgccggttttgtgggaggatataacggtcaatatttagaatcacttctggacgcagatggaatttcctatgaatttgagcatatcaatggcgaaacgagaagctgcattaacattttagatcccggatatggttctaccgaatatctggaaggcgggtgtgaagttacagcggaagaagaaacttcatttttagaaagatttcccgggatcatccggaacagtgatgttgtgaccatttcaggaagtgctcccaggggaatgggcagggatatctatcaaaaaatgatccggatcgttaagaagctgggaagaaaagtgatcttagataccagcggagaatatttaaagagaggtcttgagagcctgccaactatggtaaaacctaataaagatgagatagaaatgctttttgatatcaaagtccgcagccaggaagatgtcataggatatgctcaaaaaatctacgaaaaggggatcccatatgtagtaatttctcttggaggcgaaggggctttactcgtatgcaaaaaaggcatttatcagggtaaaccgccgagaatagaagtggtaaatacggtaggatgcggagactctatggttggagcgtttgcagtcgcattggagagaaatatggagccggaagatgccctgaaattcgcagtggcagttgcatctgccaacgcgctctcatccaatacagggacatttgatcctgcaaagagagacgagatcagccagaacgttaagataatcaaattataatatccggaaagggaaagttatgttaacaacatcgaaagaaatattactgaaagcacaggccggcggatacgcagtcggtgcattcaatgtagaaaatatggaaatggtacaggcagttgcagaagctgcagaggaattacagtcaccggttattatgcagacaactccgtctacagtaaaatatgcgggacttgattattatcttgcaaatgttaaaacagcggcagagaggacatcggttcctgtagtgatgcatttagatcatggcaatagctttgaacttgcgatgcaggcactcagagcgggttatacttccatcatgatcgatggttcccatgaggcatttgaagttaatatgactgtcagcagggcagtcgcaaatgcctgccatccatccgaagttccggtagaggctgagcttgggaaggttggggggaaagaagatgatttagacggcggagatgataatccatatacagatccacaggaagcgaaggaatttgcagagagaacaggggttgattttctcgcagtggggattggtacagcccacggtgtttataagggagaaccaaagcttcagtttgacatcttaagccggatcagagatgttgtagagattccgctcgttcttcacggaacaagcggtgtgccggacgaagcggtaaaagagtgtattaaacgtggtatctgtaaagtaaattatgctaccgatctccgtattgcatttacaaaaggagtaaagggtgtttttactgcagatactgatactattgatcctaagaaatatagcgcagcaggccgtgaagaagtaaaaaaatatgttatgagcaaaataaaagtttgcggaagtgcaggaaaagcgcagaaataaaatatcaattacaaaatggacgtaagtcagctttgtgcacagatgtgtaaggaaatcatttgtctttataaaatatcaaaaataatgtaaaataagattatatatgaaagaattactcgtacataccccggtaaataagatcacggtaaaacagatcgtagatcaatgcgatgccaccgaagatttacaatttatttaaagatatttagaaaagataaggtgttacacttttaacgaaatgtaacattatttatattttaccaaatgtgtaacttgtattgctacttgaacaattttataacggaaatagttaaaaaattgcgtatcgtattaaatggaacatcttatcacggagcaggagcaatccaggaaatcgcaacagcagcaacaggtatggatgcattaacacatgccatcgaaggatatacaacaaaagctgcatgggaaatgacagatatgttccatatcaaagcgatcgaactgatcaaactgatctctgaaaacttaagaggagctgttgaaaatacaccagaaggaagagaaggaatggcaatgggacagtacattgcaggaatgggattctcaaacgtaggacttggaatcgtacattctatggctcatgcattaggtgcagtttatgacataccacacggagtagcaaatgcggtccttcttccaacagctatggaatataacgcagatgcaacaggagacaaatacaaatatattgcaaaagcaatgggtgttgaaggtgttgaagatatgacacagaaagaatacagaaaagcagccgttgatgcagtgataaaattatcagcagatgtcggaataccagcagatttaaaagaattcgtgaaagaagatgtacagtttttagcagaatccgcttatgcagacgcatgcgcaccaggaaatccaaaagatgcgagcgtagagtatattattgcactttataaatcattattataattttaagacatctagtcttcaaacactatacttatgataattacaacaataatatataaaatacaataaataaaaagaaggtactggatttcaattcagagaaaagaggaattcagtaccttttttgcaaacataattttcaagtggaaatacagattgctaattgtcatcttttttaggaattgttataataaaaaaatagttaaaaatacctttgtgaagagagatgtggttatgttagattacagaatgaaaaaaattattatagaattatctgacaagaagtatgtcacagcctcagaacttgctaaaattttggatttgaatgagaagacagttagaacaactatagctaaaatgcgtgattctgtagatgaatatggggtggaaattgaggctaaaacaagaaaagggtatcatttgattattaatgataagaataaatatcagaaattgataaatgacgatgcatttttgttgaaaacagatattccgaataattcaaaagaaagggaagaatggctgctggattatttattgaaacagcataaatttgttcgaattgatgatttgagtgagatgttgtatgtatccagatcaacaatcacaaacgatttaagaaatgttgaagatattttaaaaaattatcatataacattgattcgacgaccaaattatggattgcatgtacagggaattgagtttgatattcgtaattgtatgatatctcagtttaaagataatcaatggacgaagagaatctcagaagaaaaaacacgagaattgaaaataattttagagattcttttaaataatattcagaatcaaaaagtagttttgtcaaaatctatgattcaagaaatgatgtattgtatttatatttcaaaggtacgatatgaagaacattataaaattacagttagcaaaaatgaagtagttaatagaatttataaaccatgtattgatgttgcacagaagattatagaggagataaataagagttttgttattaatcttccagattctgaagtgtattatattgctattaatattgcggcaagaagcgattataatgtattagaaggagaagtggaatcaggagttatcaatcaggcaagaaaacaggcaacgcagatgttagagtgtgtatacgatatgatgcatttagatatgcgtcaaaatcttacattgttatatgatttgatcattttcttaattcctatggatatacgaatgagatatggcatcattgccaagaatccatttgcagatgcaacaaagaaaaaatacttttttgcatataatgttgcatcgcaggcagtcataccattgaaaaaaacatattttcatgaaattccagaaaatgaaattgcatatataaccagtatttttgcattatttattgaacaggaaaaggataaaaagaaaaaatataatattctggttatttgtgcaaccaatatgagtacatcgaaattattggcgtatcaatataagaagaaatttaagaaatatgtggatgaagtgtacacatgtgagatgtataatttggattcttttgatttttcaaaagtggattatatttttacaaccgtggagattaacagggttttaccgaaaccggtattaggaatttctgctttcttagaagacgaagaagttgataagatcagctctattttgaaatttaaggcttcaaatacaattgcagatgtgtataatgaagagttattctatgataatataaaaggggaaacaaaagaggaagttctatttgaaatatgtcagagaatacctgagaaatatggaattccaacagatttttatgagggtcttttaaggagagaggaaattgcaggaactgatcttgcaaaacatgtagcacttccacatccgtacgaaacaacatctagtataagttttgcctgtatagcagtgttagatcatccaatccaatggacaagacaagaagtgcaggtagtgattttaatgacggttgcagaagatgagcaaagagatttaactaatttcttgcaattaatctcagaatttattgcaaatgaaaaagcggtattacaattaattaaagaacgaaactttacggcttttgtaaatttgttgtctcaaattgaaatgtaaataacaaaaaaggaaataatgaattacggcaattgttaacatgtccttaattgatagtttgggatgttgggatgtccgtaatgataacggacattcctgttgtggtgtctgattttgaaacgttgtatatttaaaacatgttaaagatgtaatgtgttttagatatacaacgttttttatttaaaacaataaaggaggtgctgcgatgggaaaaagtcaggtaatgacagtatcaggattcgtggatgctgaacagttgggaacagtttatgctcatgaacatttgattgttcaaccacaaatttcagaagatcaatatatcctatatactttgaaagatgagaaagcatctttcaaagaagcagaatcatttgcaaatgccggaggaaaaacaattgtggaaatgactccgatatattatggaagagatgttttggcataccaaaggattgctaaagaagcagggatatatgttgtatgttgtacagggtttcataaagaattgtttatgccaccatggtttaaggaaaagaaactttcagaattatatgatctggttgtagatgaaattaacaatggtatggatggaacattgatacaaccgggagttataaaaatgggaacaagttttgaaaccattacgaagcaggaagaaaaatccatagagattgttgcaaaaattcatcgggatactggaattccgataagtacccattgcgataaaggaacgatgggaattgaacagttagacatgttagaacattatggtgtatttccagaagaagttttgttaggacatattgatagtaaacatgatattgattatgcaaaggaactgtgtaaaagaggtgcaacaatctgcattgatcatgtaggaagatgtttaagtgataaagatgcattttgtgttcgtatgattacagatttagtagaagatggatttgccgatcatgttgtattatcaggggacatgggaaagatggattaccttttagcatatggaggaacgccgggactcaaatacatattaacagatttaaagaatacgctgttaaagcatatttcagaagaagacttttggaagatgttgattaagaatccacaaaggtttttaagtggaagtgactagtaaaagaaagggacaaaaatgcagttagaagatatgttatttccagaatgtacactagttcatgtaaaagctgacagaaaagaagatgttatctggaggttatatgaaaaactgttgcaaaatggaaggataaaagaaagtttttatgatgcagttttagagcgagaaaaggaatacccaacaggacttaaatttgaagagtgggaagttgcaattcctcatgtttcgccggaacatgtacttgcttcgacggtagccattgcagttcttgatgaaccaatcgaatttaagcggatggatgatgattcttttgtccatgtaaaagtagtatttaatatcgcactaggaaaagacggaaaacaaatagagattttgcaagatattatggcaattttttcaaattctgaaaaaatggaacgtattgtaaatgcagaatcaccagaggaagttatttcaattatcaaaggttaagatagttttctgcacagacaggataatccgagaaccttatgtcaagtgactttcgcggaataacggagctttgctccattattccacgtttaagtgacgaaaagccattctcatggcgagaatacatgggccgaccccgcagttgtcagatacctgatagccgatgatggaacgtttggcagcatccatgatgaaacagatgtaagtcttgataccacggattttgatataggtttcatcagcagtgaagacactgccggagccataatcgtagttatcgacaaaaggtttaacgcagatagcggccgttctacagtaattagctatctgctgatgggagatggagatattgtacaaatcttttaaggcctgagatgtttttctgagagataatccaagatttatgtggagagtcaggcacagagccattgtgttggaatcgaacttgctgaatttcagggaagatgcattctttggtaaagagtttaaatccatgcgaaaaaaatctatcgtgaattcacggtagatgtagtggagtttgtatttattcttgccatagtcctcattcagatcttttttatcaacgttacgaagattgtgaagatagtaagggcacttggggtttacacatttatgaatgatgaagtgcttgcagttcttttttggaacgagtgtgttccacagtgggggcaacagcatacatctggaatatcacactcggaccggcggttgacgggacggattttcttaccgtaacgtttttcaaagtaaggaatcagttccttgtaagtccagtcctgacggaaatcagtgatgagaggaagctcgtccgttttgaatttctgatactttggagaatgggaatcatcaaaagcccactgccggagaggaatgtatctgcagataaaggaaaaaagatagcgaatcattcgctgttggtattgaatgtagtgaagtaaataaagtataatgtccatgagcattggctcctttcggtattttggaattttggtcgaggatattataccaaaaaagggaggtcaatgctctttttattgcaaactcccataaactcaaggtttaacaataaaaaacggtagtgaaacttgacactaccaaggttaattaggaggaaacgaaaatgaaaaaaattatggtatgctgtggatcatcaatgattacttcaacaatggcaattaacaaattaaaacaggcaatgcaggatgcggggattggtgcaaaatttatccagtgcaaatttgcagaagttcaggggaaagtaaaggaagaacgtccggatgtaatagtgccaacaggggctttgaaggatacattaacagatgatgttccggtagtagttggcacatgttttgtaacaggggttggagaaaaggatacaattgaaaaaattgttgaaatattaaaaaaataaaaaacaggaggaaagtagatatgaaattacaggtagttattgatgcattaaactggatctgcggattaggaccaatgtgtatgatgccaatcattatgtttgtaattggtatttgtttaagggttcagattagtaagctgattaaatgctgtattacaacgggtgttggattttgtggggttaatttggttattaacgcatttattgctcaggttggaccaagtgtgcaaaatatggtaaaaacatttggcttacatacaaatattatggatgtgggatggcctgcacgtgcagcagcgacatgggcatatccaatggcggcagttgtagtatttgtagtattaggattaaatattttaatgttagttcttaaattaacaaattgtgtcatggttgatttctggagttataatcattttattttctgtgcagcaatttgttattatgcatcaggaagtgtcattgttggattaatctgtggtgctgtttgtgcggtagttacgtttaaacttgcagactggacgcagccggtagttgaagaagcgtttggtttgccaggcgtatcatttccaacatctaacagcatcagttgggcaccattagcttatttattaaataaattatatgacaaaattcctggattaaataagttgaaagctgatcctgagtcaattcagaaaaaatttggtattcttggagaacctctgatcattggattgattttaggagttatttttggaattcttggtggaaatgatgtagcaggtgttatgagtgttgcaatgtatacagcagcaactatgttattaactcctaaaatgatgcaggttttaatggaaggattaattccatttgcagatgctgtaaaagaactattaaataaaaaatttgaaggaaacaatttccatataggaattgatgcagcattaacgattgcaaatcccagttgtattgcagttggtattttaatggttccaacaacaattgtattagcaatggttttaccatttaacagattacttccaatttcagatattgcatatcaggctatgtggttgtctgcatatccagtagcttttagtaaaggaaatgtagtaagagcatatatttcttgtgttattttcacaacaattatgttaggaattgcaacagcattggcaccggttcatacatcattagcggttgctggtggatataaattaggaaaagcagttttagtatcaacagaggatgcgggaactcatttattatcttatattctatctttgattgcgcgaattttctagatacagattttaaataacgcagagcagacaaggcaggaagaaaaggagattattgatgaaaattacagatgtcgttgtgtatgaagtaaagcccagatggatttttgtaaaggtttgtacagatgaaggaattgaaggctggggtgagatgatctcagggaccaaaacggaaacagtagtagccggagccaaagaaatgggtgcatatctgatgggaaggaatccttttgaaattgaacgtttatggcaggaaatgtataaatcgttttttagaggtggaccgattaacggtacaatcgtatcaggatttgaaatggcattatgggatattaaaggaaaatattatggaattccaatctacgaatttttaggtggaaaagccagagatcgtatcaaagtatattcatggattggaggagatcgtccggacgatgtggcaaaagcagcattagaaagaaaaaaaatgggatttgatgctgtaaaaatgaatgctacagaagaattacattatgttgatatgtttgataaagttcaggcagttgtagacagggtcgcatctatcagagaagttttaggaaatgattttggaattgctgtagatttccatggacgagttcacaaaccaatggcaaaagtactggcacatgaattagaaccatataaattaatgttctttgaagaagtagttttaccggaaaatgaagaaagtttccaatcaattgcaaatcaggtatcaacaccattggcaacaggggaaagactggtcagtcgctgggagtataaacgattgtttcagcagggggctgtagatattatacaaccggatgtggcattgtgtggtggaattttggaaaccaaaaaaattgtatctatggcagaagcatatgatatggcagcagcaccacatgcaccatacggacctattgctcttgcagcaacattacaggtggatgtctgctctcctaatgtatttattcaggagcagagccttggaattcattataataaaggattcgatctgcttgattttattaagaacaaagaggtttttcagtataaagatggttatgtggatatacctaaaaaaccaggacttggtctggagattgatgaggatatggtgaaagaggtttcagcagaaggacttcactggacaaatccaaaatggagaaattatgatggaaccatggctgaatggtaagagggagaaaatgaaatgtgtaaattgttagatcataaaattgtggcaatcgcaagagggatagatgaagaccatatcatcccaacgattcaggcactgattgatggtggaattaatgctgtagaactgcctttgagtcataaatccaaagaagcgtatgataaaactttgaaaataataaagaaagtacatgatacatttggagataaaatttacttaggagcaggaacagtactaagtcctgaagaagtcgaaaaagcagcagaaatgggtgcggaatatatgatttctccgaatatggatgttgaagttattaaaaagacaaaggaattaggcaagggatcaatgccaggagcatttacggcaacagaagttttaacagcatataatgcaggagcagatgttgtaaagattttcccagcagggaattttggtgaaagttatattaaagcacttcagggaccatgtgattttattccatatgctgcagtaggaggagtaaatgcagacaatatgaaatctctgttggatgccggatataacatggtagcagtaggaggtaatctggtaaataaagaattagttatgaaagaagactataaacagattacagaacttgcaaaaaaatatatacaaaatgtttaattaatttaaatggagaaagtctatagaattattcaaaagtcgagtgtgtgaaactttttctgtaaaatagaacttagaaggttcttctatgataaaataaaaatcataggagggccttttattatggcaagaaaaaagaaaccagtacacaaagtacaaatgacggaagggaaacgcaacatcatccatcagctcctggaggaataccatatccaaacagcacaagatattcaagatgccctgaaagatctccttggcggaaccatcaaggagatgatggaagcggaactggatgatcatttgggatatgcaaaatcagaacgctccgacaatgagaattaccggaatggatacaaaccaaaacaggtaaatagcagttatggttctatgcagatccctgtgccacaagatcggaaatctactttcgaaccacaagtggtgaaaaaacggcagaaagatatttctgatattgaccaaaagatcatttccatgtatgcaaaagggatgacgacccggcagatatcagaaaccatggaggagatctatggctttgaaacctcggaaggatttatctctgatgtcacagacaagatcctgccccagatcgaagactggcaaaaccggccactggatgaggtctatccaatcctatatattgatgccatccactattctgtccgtgacaatggaatgatccgtaaacttgccgcctatgtcattcttgggatcaatgcggaagggaagaaagaggtacttacgattcatgttggagagaatgaaagctcaaaatactggctgtctgttttgaatgagctgaaaaaccggggcgtaaaggacatccttatcatctgtgcggatggtcttacaggcataaaggaggccattgctgctgcattccccaaaacagaatatcagagatgcattgtccaccaggtgaggaataccttaaaatatgttccagataaagacaggaaggcgtttgcagcagatttaaagacgatctaccaggcatcggatgaaaagaaggcccttgcagcccttgaacgtgtgacagagaaatggacacccaaatatccgaattcgatgaaacgctggaaggacaactgggatgctgtttctcccatcttcaagttttcagcaaccgtcaggaaggtgatatacacaaccaatgtcatagaatcactgaattccacctatcggaagctgaaccgccagagaagcgtattcccaagtgatacggcgctgttgaaagcgctgtatttagcgacatttgaggctacaaagaaatggacggtaacgatgcgcaactgggcacaagtatatggggagttaagcatcatgtacgagggacgacttccagagtaattcaaagacggcctaaaacgggcggatttaccgcctgctgttgacatgtttttttgtaactgttatatataaagtaagggcgaaaagcctgtttttcaagactttcgcccttcattatcatagaagaatcttatttacagactttttttcatagtctctttttgtagtttatttgaatcttacaggaattttacagcagttccataaacaataatttcagcagctccctgcataacagcagaaggggaatatcttacattgattacagcgtcagccccaagttcttcggcttcttcaaccatacgctccgttgccagatctctggcttcgttcattatttttgtataagatttcaactccccaccaacaagagacttaaatccctgtccgatatctttttcaaagtttttggactggatcgtactacctttcaccaatccaatcgtttctaatttttttccgtaataaaatcagtgttcacaatgatcataatggcatccatttagaatattcttcaaagattttatttaccgaatccacttgaaaaattcagtgttttacagtaatatacaaattgacagaagaaagaaaaaattatgaaatagcctgaatatcattcttttaagtcttgacaaggatttatgataggttataatggaatgtataaaaactgaataggatcttcagggcagggtgaaattccctaccggtggtacagcccacgagccgcaaggcatgattcggtgaaactccgaagccgacagtatagtctggatgaaagaagatagtgataaaagaactctgggatttacgcacagcgtaggtcagatgcatttggtgtatttggcgtgctgttataaatctcagttttttgttttcatattagctgtttgtttagacagtttatctatgagtgaactttagcttaagaaagccctgaagtcctgtattgtaggattttggggcttttttatttcttgcgaaataccttatcacgcttatacgcgagagtttttcctatgaaatacaaagcgttccgcgatgctgcacacatgagaaaggaggtttgtccagttgcaggaactttatatgagaagggccattgaactggctgggaaaggaacaggatataccaatccaaacccgttggtgggggctgtcatcgtaaaggatgggcggataatcggagagggattccatgagacatacggaggtctgcacgcagaaaggaatgcgttaaagaactgtacggaagacccaaaaggtgcggaactttatgtgaccctggagccatgctgccattttggaaagacaccgccttgtacagaggccgtcataaaaagtggaatcaggaaagtctatgttggaaatattgatccgaatccaaaagtttccggtaagggtattgatattttaagagagcatggcattgaggcagaaacaggagtacttgatgcggaatgcagagagatcaatgaaatctttttccactacattgcccacgatacgccttatgtagcattgaaatatgcaatgacactggatgggaaaattgcagtgaagacaggagagtccaaatggattaccggaagggaggcaagggaacatgtacagtttctcagacaccggtatgcagcgattctcgtgggaatcgatacggtcttaagtgatgatccgatgctcaatgcccggatcataggcgggaacaacccgacacgtgtgatctgcgacagcagactcaggctccctttaagttcgaaaattgttcagagtgccaaagtaattccgaccatcattgcggcatgtgaaagaaacgaaaaggcgcagaggcttgaggctttgggatgccgggtgctgatatgtccggagaaggatggaaagacggatctgctggaacttctgaggacactgaggaaagaaaagatcgatagtatccttgtggaggggggagctgatattaacgattcagttattcagaccaaatcggtaaacaaagtgtatgcttttgtggcaccgaagcttttcgggggaagacaggcaaggtcaccagtggaaggaaaagggatagataaaatcagcgatgcgatacttttaaagggcccggagattaccaggctcggcgaagatctgctgttagaatatgaagcgaggtgagaatgtgtttacaggaatcattgaagaaataggcaccgttctgtcagtaaaaaaaggagggcagtcctcagccgtcaggatcggggcatccaaagtcctgaaagatatccatacaggagacagtattgcagtcaacggtgtatgccttaccgcggtcacatttgacggacaggggtttctggcggatgtgatgaacgagacctttgaaaagagcagtctgaaaagcttgaagcctggagatccggtcaatttagagcgggccatgaaagcaggaggacgttttggcggacatatggttgccggccatgtggatggaaccggaacggtcacatcagtggaacaggatgccaatgcagtttggtttacggtggcggcaccgtcagagatcatgcggtactgtgtcagcaaaggttccatcgccctggacggcatcagtctgaccattgcaaagaccggggaccaatggtttcaggtttcggtcattccccacaccttaaaggaaacggtactgggagcaaaaaaaactggagatctggtgaatctggaaaatgatatgatcggaaaatatgtggagaaactgatgaatttggggcatgatgaaaaaaccagtgccattacagaggaaatgttaatgaaagcaggattttaggaggaaagaacatgaagttcagcacgattaaagaagcattggaagacttaaaacaggggaagatcatcattgcaacagatgatgaagacagggaaaatgagggcgattttatctgtgcctctgagtttgcgaatactaacaatattaattttatggcagtccatggaaaaggtttgatctgtatgcccatgagtgcagctatgggagagaaacttggactgtctccaatggtaaccaagaatacagataaccatgagactgcatttacagagagtattgatcatgtggaaaccaccacgggaatttcagcagtggaacgttctgtcacagcgctgaaatgtatggagaacagcatcagaccggaggatttaaggcgccccggacacatgtttccgctgatcgcaaagccgggcggtgttatggagcggaacggtcacacagaggcaacagtggaccttatgaagcttgcaggtttaaaagaaagcggtctgtgctgtgagatcatgagggaagacggcactatgatgcgtaccacagaactcatgggactggcagagaagttcggccttaagataatcaccataaaggcactgcaggattaccggaaaaaacatgaagtgttcgtgagcagggaggcggagacgccgatgcccaccaagtatggagagtttcgggcttacggttatgtgaataaactaaacggcgaacatcatgtcgccttagtaaaaggaaatgtagatgacggggagccgatattgtgccgggtacattccgagtgcctgacgggagatacctttggctcgttaaggtgcgactgcggagatcagcttaccacggccatgagacagatcgaagcggaaggccggggaattctgctctatctgagacaggaaggccggggcattggtttgatcaacaaactgaaggcctatgctctgcaggaccagggaatggatacggtagaggcaaatctggctctcggatttgaagaagaccaacgggaatattacataggagcacagattctgagagacctgggtgcgtctaagttgagacttttgacaaataatccgacgaaaatcgaaggtctgggtgatttcgggctggaaatcgtagagagagtgcccatccagatcaagctcacagattatgattctttttatatgaagacaaaacagaaaaagatgggacattatttaacttattaagctgcaaataaataagaaagaggagataaaagatgaatgttttagaaggaaaattagtcgcaaaagggatgaaagtcggcattgtcgccgccagattcaatgagtttatcgtatccaagctgctttctggggcattggacggcctgcgccgccatgacgtgaaggaagacgatattgctgttgcctgggtgcctggggcatttgagattcctgttgccgcacagaagatggcgggatcagggaaatatgacgctgtaatctgtctgggaaccgtgatccggggatctaccagccactatgattatgtgtgcaatgaggtatccaagggtatcgctcacgtgtctatggagagtcagattcctgtgctgttcggtgtactgaccacggaaaatatcgagcaggccattgagcgcgccggtacgaaagccggaaacaaggggtatgactgtgcactgtcagcgattgaaatggtaaatttattgaaagagattggttaaactggacggagccgcttatttactgtaaaatagaacagaaaataagcggcttttttattaccgttttgtttgtcttttaaccctatttgaagatacaaggagataattgccatggaccagattgaacaacttcagaatatgatagatgagagcagcaggattgttttcttcggcggggcaggagtatccacagaaagtgatattcctgacttcagaagtacggacggactctatcatcaaacttataaataccctccggaggtgattgtcagccatacattttttgtgcagaagacagaggaattttatgatttttataagaagaaaatgatatttccggatgccgaaccgaatcctgcccatttaaagcttgcagagcttgagagggctggaaagctcacggcggttgtcactcagaatatcgacggtctgcaccagaaagccggaagccagaaggtatttgagctgcacggaagtgttcacagaaattactgtcagaaatgccataagttttttgatgtaaactatgtggccggagcacagggagtgccgcactgcgacgaatgcggaggactggtgaagccggatgttgtactatatgaagaaggactggatgcatccgtgatgaggggagccatcgatgcgatttctaaggcggatatgctgatcatcggtggaacttctctcgtagtgtatccggcggcgggcatgatcgattatttccgcggagagcatttggtgctcatcaacagggatgccacatccagagaccggcaggcagagctctgcattacagatccaatcggtgaggtccttgggcagattaaggtgaattcatgaaaagaagagatatcgtgttgatcggagtagttctttttatggcagcggtgggatttttattcctgtctcttgtgaagcaggacggggaaaaggcagtggtgactgtggacggaaaggaagtctggagccacagcctttctgaggatgcggtctatacggtaaagagcaggaacgggtccaatgtagtccgcatccagggagggaaagcctcagtcacagaggcagactgccctgatcagatatgcagaaagcataaagccatcgataaaaccggggaaaccattgtctgcctgcctcataaactcgtagtggaaattaaagacggaaccaaggagaaagaatatgacggaattacaatctaaggagaaaaaccaatgaccaggcggattgctgtggatggcatgtttctgacactggccatcgttgtttcttatatagaggtactccttccgattcctgtagggattcccggagtgaagatcgggcttgccaacggagtcattatggttcttctcttttttaccgggtggaaacgggcgctgtttatctccgttttgagaattcttctggcaggaatgctttttgggaatccgatgacgattgtttacagcctggcgggcgggattttgagtatctttctcatggcgcttctgaaaaaagccgggggattttcggcagtgggactcagcgttgccggaggagtagcacacaatctcgggcagctcagtgttgcagtgtgcctgatggagaatgtaagaatttattattatacgccgatactgctggtcaccggaaccattgccggcattgcgatcggagtgctgacggcggggctggtaaagaaggttccggcaaacttatttcagtagaaaatgtacgtaatttttactgaataagtatccatttagcaaaaggagctatccaatgatagttttttatcactattggaggaacgtattttaaagtgtgacggaaatagtgataaaaaactcctacaggaggaaagatgtgaaaaaaaaattatgtgcggtcatggtatttgtgctgacggcggtcatggcatcaggctgtgtgaagaaagaagagatacagaaatattcccatgtagactatgccatggggacagtgaccaatacgacactatatgggagaagcccggatctttctgaggctgaacaagagatgatggagaagatgaagaagctggagacagagcagctgtcctggaggaaggacagttctgccgtggcaaagcttaatcaagggaatcaaagagtggcggatgtcccggagccgctgtttacctggatgaaaaagtctcttcagattgccaaagacagcaaaggcgctgcggacccggccatcggaagcctcactcgaatgtgggattttgaatccgagaatccaaaggtacccgatgctgataagatcaaagcgctgatcaaagacggtatcgtcagcaatgcatatgagcatgtaaaactgaatgaaaagcagaaaaccgtgcgaaaagcgagagagattaaaatggatctgggagctttcgggaaggggatcggaaccgacgaagccatgaggtttctcaaaaaagaaaagataattaccggagccatggtggctcttgggggaagcatcgctgtttatggagaaaagcccggcggggaggactggaaagtcgggatacagaaccctgacggaaagcagggggagacaattggagggcttagcgtaaaaggcgggaccttcatctctacctccggtgattatgaaaaatattttattgataaaaagacagggaaacggtatttccacatcttagatgagaagaccggatatccggcacagacagagatcacctcatgtaccattgtgtgcagttcaggtattgccagtgacgggctgtccaccgcatgttttgtgctggggccggaaaaaagccgttcactgttgaaaaagtacggagcaaaagcgatctttgtggataaacaaaaaaatgtttatgtcagtgacggattagattttgagctcacagacgatgcatataaaatagttaacaaagacattgacggatgaaaaaattctgaaccgacccccaaaagttagaccaaaaatctaacgattggaggtcggttttattatggcaaaatatagccttgagctaaaaaagaaagtagttgaagcatatcatcgccgggagggtagctattgttttcttgctcaaaagtatggaattacaaataagcgtcaggttttaaattgggttcattcatatgatgcgtttggctgtgaaggcctgatgcgttccagaaaaaagcaaatgcagtccgtgctagatactactcctgtagatacaagtgctgaacatatcaaacagctcgaagatgaattattaaaactgcgaatagagaatgcctatttaaaagatgtgaggaggctgcgtttagaggaggaagctcttctgaaaaaaaagcgagaatcatccacagcctccgaggagacttcaaattaaaagatattctcgctgttgttgggtttccgaaagcaatctatatgtactggcaaaaaagattccagagagataatcctaataaagagcttgaggaaaaagcatggaaattacttcctttaccagaaaaagccgtaagtatagctcatataaaggacggattggaaaagtggctccgaacagattacggagacgttttgatacgaaaatcccacaccagaagattacgactgatacatgcgaagtggattttccacttcgcaataaagtctaacttttaggggtcacctcattcatctgccagtgtcttttttagtgattaaaataaaattctttatttttctccgcggggttttccgcaggtctgccttttaatcagtgtacacggcagtgtcaggcgcaccggtgtcttgtattcgcttggcacttcgttatagagtttcgccacaaagtttgctgcatattcccccatatactctgaaggagcatggaccgtagtcagcggaggattggaaaattcggccacactgatatcatcaaagccgatgatcgaaatatcgtcgggaattttatacccatgttcatagagggagcgcatggcgccgatcgcgattggatcgctggcggcaaaaactgcagtaggcagatttccagattctataagtctgttcatcatctgatatccggattctgcgctgaattcttcctctataacataaggttcataacagagttcaagtttcctgcagtaattgataaacgtttctttccgctgctcaaaatagacggtatcctcgtcgatgtattcctttccgcccagataaccgatccttgtgtgtccgagttccacaaagtaatcaatcacatctatgacagactggtgtaaatccagtacaatgttattgaaggaaatcctggaagtgcgcatatcaataaaaataatattgtccgtaagctgctcaaaggctttgatatccttttgcgcaaactttccaatacagatcaggccgtccacaccgcttaatgtttttaaatagtccggatcactctggaatgcccggatgacttcaatgttctggtctgcacagtatttctcgatccctacgcggatgttctggtagtaggggtcttctaattcctgaaacagggagtaccactggaacactccaatggtagtccttttcgttgttcctttccccttttttctgtagttcagaccgtctgcaatctttaaaactctggctcttgtctcatcagtgacgctcagggtgtcatcctgatttaaaatacgggagactgtggcggatgatacgcctgctttttcagcgatatctttaatggtagccatatgaattctcctttagcatctaattccaactcttttttattccaagtataccatatctgtaaatgaaaataaaatctttttattataatttactaaaatatagtgaataaatttagtaaataattaagtaaaatatagttgaaatatttactaaacagtattactatatagacataggaacgaaactaagatatgaaataggaggcttgatgtatggaaacgaatagtggcagagagagggaagtggtttccgtccttccgcgtatttttgccagtctgggacaatccctgatcattgccggtttcggagtgtagatcattggggctctgggaggaggttatatcgggtatcacagatttgccatgagcagacgggatacataccaaacagcccggaccagagtatgctgaccatgaattccatacggatactgatgtgtgccgcgcctgcgctttcaatgctgactgcatatgtcatttataaaaatgcatataagctcagcgacagttttatgaaaaaggttatagaaacgatacaggaaaggagatttaacgcagaagcctgacattctgcggaggtgaaaagatgaaagattcaagtgtgttgatcaaagaatttaaaaaaggaacttatgagagtctgttgaaagatatttatgtagatgacagtgtgctggaatatcagagagaaagatacataaaagcactgaatcagtatgaagaaatattcggggaagaggaagtggagatctattctgcaccgggacgaagtgaagtggggggcaatcacacggaccatcaatatggtaaggttcttgcaacgtctattaacctggatgccattgcagtgactgccaggacagaagatgagaagatcacgatagtatctgacggatatgagcgcatggaaatcggtttaaacgacctgcctgccaaagaggatgaaagagaaacctctctggcactaatcaggggggttgccgccaggctgaaacagaaaggtcataagataggaggtttccgggcatatatcaccagtgatgtgctgatcggcgcaggaatgtcttcctccgcagcctacgaaaccttgattggtacgatcctgtccggactgtacaatcagatgaaactggacccggtgttcttagcccaggcgggccagtatgcagaaaatgaatattttgggaaaccatgcggcctgatggatcagatggcgtcttcggtgggaggaatgatctatattgattttgaaaatccggaggagccggaagtaaagcaggtaaaagttgactttgaaggttttggacacagcctctgcattgtggatacgagagggtcccatgcggatctgacagaggactatgccatgattccgtctgaaatgaagcaggtggcccattattttgaagaagatgtgctgcggaaagtagacaagaccgacttttatctgaatataccggccatccgtgaaatccttggggaccgggccgtgctccgcgccatgcatttgtttgaggaaaataagagggtggaagaagaggcggaggccctggaacagggaaaattcgaggtcttcaaaaaactggtgaaggattcaggagattcctctttcaagtatttacaaaacgtatattccaatcaccaggtgaacaaccagagtgtttccatcggacttgcagtcagtgatgtgatactgaaagacagaggtgtaagccgtgtccacgggggaggctttgcaggaaccattcaggcttttgtaccggatgagatcgttccgctgtatcagaaaaccatggacagtgtatttggagaagaagcgtgccatattttgaaagtccgcaaatacggcggaatgaaagttttatagggagacaggacaatggcggagatgaaagtgatcgaacagcgacaagacggcattgacatcattgagatgaagaatcaggatctgacagtgagagttacaaatctgggatgccacattctttcggtctggatgaaagacaacaaagaaaatatagacgatgttgtgctcggacttcaaaatatagaagactataaggaggatgacaaatatatcggaggaatcctaggaagggcggcgaaccggatcaaagacggaaagtttacccttaacggacaggagtatcatctgccggtcaataacggaccgaaccatcttcacggaggcacagaagggttcgataagaaagtctgggattatgagatccgggaccataaagtgatcttttcctatctgtcaaaagatatggaagaaggatatcctggaaacttgaagatacatgtttcctatgaactgacaggaaatacgtttaccatggtttactacggaacaaccgacaaggacacgattgtaaatctgtccaaccacacctactttaacctgtccggaggaaaagaaaagatttatgaccataagctgaaaataaaagcagctcagattgcctgtgtagaccaggacggatgtactaccggcgaaaaactcttcgtggacggcaccccgttcgatttcagaaaattccacaggatcggggaacggatcgatgaagatcatgaacagcttaactttgcaggagggtatgaccacgcttttgttttcagcgggcagaaagaccagatcacgctgtttcatgaagaaacagggagaaaagtgacagtttccacgaaccttccgaccgtacagctttacacttcaaactttctggaaggaggcttgccggggaaagagggaagagtcaacgtaaacagggacggtgtctgcctggaaacccagttcatgccaaatgctgtcaatcttgaggaaaagccacaggtgatcctcagaaaaggcggcagttatgcagtgtttaccgcttttaaattcgaggtgcaggaagatgattgatgaatatattgcaaaattagtacagtatgggctcgataaaaaactgatcgaaccggaggacaagatttacacgatcaatcagtatctggagatctttaagctggatgattacgaggagcccaaaagacctgccggggagatcaatctggaagaaatcctgacaaaactgacggatgaggcatatgaccgttatattataaagagcaatgatgtcgtgacgagagatctgtttgacacaaagctcatgggtgttttggtgccgaggccaagccaggtgatacgggatttccgggagaagtatcaaaaaagtccggaagcagccaccgaatttttctataagttcagtcaggatacagactatatccgcagataccgtgtgaagaaggactggaagtggaccgtagacagcccatatggaatcattgatattaccgtgaatctctccaagccggaaaaggacccgaaggccattgccgcggcaaagaatgcggcgcagagccgttatcccaaatgccagctgtgcatggaaaatgaagggtatgcagggcacatgaatcacccggcgagacagaatcacagagtcattccggttacagtcaacggcagcagatggggattccagtattcaccgtatgtttattacaatgagcactgtatcgtatttaacggagagcatgtgcctatgaagattgaccggacggcgtttgtgaagctgtttgattttgtcagacagtttcctcactacttcctcggctccaatgcagatcttccgatcgtgggaggttccatcctgtcacacgaccatttccagggcggacattatcaatttgccatggcagatgcgaagatcgaaaaacattatacgatcaagggatttgaggatgtggagacgggaatcttaaactggccgctgtcagtgctccgaatccggtcaaaggacgagaatcggctgattgatatggcggatcatgtcctaaaagtatggagggaatacagcgacggggatgcccatatttatgcacagaccggcggggaaccgcacaataccatcactccgattgcgagaaagaccggggagacctatgagctggatctcgtattgagaaataatatcacgactgtaaaacatcctctggggctgtttcatcctcatgaacaatatcaccatattaagaaagaaaatatcggtctgatcgaagtcatgggtcttgcggtgctgccatccagattaaaaaaagaaatggagcttcttgcggagtgccttgtatgtaaaactccgatcgaagaatatgaatgtcttagaaagcatgttgactgggcggagcagtttgtgccaaaatataaggagatcaacaaagagaatgtcatggatatcctgaaagaagagatcggacagatatttgtaaaagtccttgaggatgcaggagtttataaatgcaccgaaaagggcaggaaacagtttgagagattcatttttacactggatcagcagtaagaaaggcggaatgaaatatgaagattttagtattaggcggagcaggctacatcgggtcccatacggtttatgaactgactgatgcgggagaagacgttgtgatcattgataacctggagaccggatacaaagaggcggttcacccgaaagccaaattctatcagggagatttaagagacagggcatttgtggacagcgttctggatcaggagaccggcatcgatgcggtcatccactttgcggcaaactcactcgtaggtgagagcatgacgaatccgctgaaatattatgacaacaatctgtgcggcacaaagaccatgctggaatctatggtggcacacggcatcgataagattgttttttcttctacggcggcgacctatggagaaccggagaagactccgatcctggagacagaccggacagagccgaccaatacttatggcgagacaaagctctccatggaaaagatgttcaaatgggtgggcaaagcacacggactccggtttgtatcactgcgctattttaatgcatgcggagcccataaaagcggagagatcggcgaggcccacaatccggagacccatctgattccgctgatccttcaggtgccgaacggaaaaagagaagcgatcagtattttcggaaccgattatccgaccaaagacgggacctgcgtcagggactatattcatgtgacggatcttgcacaagcgcatatcctcgcggtaaaatatctgatggaaggaaatgaaagtgatatcttcaatctcggaaatggaatcggctttacggtcaaagaggtgatcgagactgcaaaagaggtaacgcaaaaaccgatcaaggcagtggaagaaggccggagggccggggaccctgcagtgctgatcgcatccagcgagaaggcaaagaaagtccttgggtggaagccggaacatgcggatcttcatgagatcattgagagtgcatggaagtggcacagcacacatccggaaggatatcagagcaaataatacaagtaatataagtaatataatgtaaaaaatggaacggttatcaggaaattagaacgtatatctggatttccaccaatatgcttgacgatcatacggtattgttctatactgaccacaagcttggcgggttttgttgttgatcagcagagacaacatccttagagaatgtaatcccagaatctgccggagcacagacaaatatttatcataattaaaaaagcaggcatgatgcattttttattgcacatgcctgttcttttttgcatttggcgtgggaaaggggtaaaatatgattatattttacgttttataatatagaaaggactgaggatggagagaacgttaaaaatagcaatctgtgacgatgaacagacttacttggatatcttggaagatgaatgcctccggttcctggagtgcagaaatcaaaaggcacaaatcttctgttttcaaaggggaaaagctctgctttcttcggaggatgagttcgatatcatcctgctcgacgtggaactgccggatatggatggattttctgttgcggaagagtggaagaaccttcagagacccggaaagatcatttttataacgagccatgatgaatgggtccagagagcttttaaggttcaggcattcaggtatctgtataaaagtggaagcggacaggagcttttggaggcgctggaagatgcgctcaaagatatgaacgacaatgaagggattgtgctggaaggaaaggaggagagcagattcgtatacttccgggagattcgatggatcgaagctctgggcgatgaaatagcggtgtttcttgtgggagggcatctgatcgtgagattgtctctgaaaaagattgaggggtgtttggatgagaggtttcagcggatccacaagggatacattattaatttccaattcgtagagcattattataaagaacggcttgtgctgttctgcggaaaggaatttcagatttccaagaggaaacagaaggaagtcaagaaacactattttgagtatataaccaaatatgcaaaggtgatttaatgaacccatatggaaaatgggcagtgagggtgaaaagtgaaaggattatattgggtgtatgtgtacgccattgaactttggaagatgatcttgatcatgagggggattttagggatcgaaccggtgcggaaacggcaggtgctgatgtttcagattccggcggttttgggagtgctggtaagctttaagtaccagcttgccgtgaatatagttattgtgctgttcattatgttgtcggcatggatttattttaataagttttttctgtcagtgtttacctggcttggaatttcgatcatggattttttgatcggactgtttattatcttttttgcacagatggatttccagacagcctataacagcaatcatttcgccgatgtagaggaagtcttcagttttcttcttttgattgttatcattgcgctccggaagagatttgaagtcaggaagatccaatatacatacagcgatgtggcattgggagccatggtattggtaggagtgatcgcctgtaccggtccttttctgtcggaagggtttgagaactggacatccatcggcaagagactggagatcctgcttggatttcttctgatgctgtttggaatcagcagtattatataccggatctgcagagtcagacaggagcaggaacagtttgaacagcagatgctgtggaacgaacggctgttaaatgaacagaaaaagtattatgaactgctccttcaaaaggaggagacgaccaaaaagatcagacatgatatgaaaagccagctggcatgcctgagcagatttcttgaaaaagaagagtacggcagtgcgagagattatctgcgtgaactgaccggaaatataaagcgtttgaatattctcatttccacgggaaatgatgtggttgatattgtggtaaatgacatcattcagagtgagaagatcgagctcagctggaaaggaaagattccaagcaggcttaacatgaccaatgcagagatctgtattttattttccaatcttctcaaaaatgcggcggaagccgtcagggatatggatgacaagaccgttgatgtcacggtcaaactcaacgggcatcatttagttttggaagagagcaaccggaccatgaagccggtgatcatagaagacggccggctgaaaactacaaaacatgacaaagaaaagcacggcatcggaagccgcaatatgatcgagatcgccgaaaagtataacggagatgtttccttccggtttgaaaacggaagatttcatgtaaaaattattcttcttgatactatttaatggaaaaaaagatgacggttattcgaatatcaagtcgttccccgcagatatattgaaacaaggaataggaccttttatagtgtgtattgttacagagataattgtcgaaagcaaagcagtataaagggggataaaacaatgacatgcatgagatggccttggcctttctaatcgtcatctagtccgttttgaggactaattacaaaggataaagaattaatatgagggtagtcttaaattaagagacataaagcaagaggcatttctgagaagatcagagatgcctcttttattatgtccggttttatgctttccacagtccgtggagattgcagtattcatatgcggcaataaattcctcactgtctgccagaaggaattctgcctccggtttttcacccggattcagatattttatctggtggccacggctggtttcaatgcagatgaacatgatgtagtgagcctccatcatagggtgttcggcttctccgacctttacgctgatcttgcggtcatccgctgaaacgaccggaacgtgtttttctgttgccccgtcggtagtgcctggaacatgcgtcatttgtctgtaaaatttggagaaaatgaagcaactctgtgacaaatttcatatactatcattagatggcagcagaaaggagcggtaaaatgtatgattttgcagtgcttggcggtgatttaagacagttttatatggcaaagcagcttgcttttaaaggctattctgtgattacctatgggatcgcatccggggaggtgcaggcttcttccatgaaagaagctgtggaaaatgcagaaatcctggtcggcccgattcctttttccaaagaccgtgaaaacctggtttccatggaatgctgtgctgacttcggaatagaggatgtaaaacggcatctgaggaaagggcagaagatctttgcgggttgtattccggatgacttctgccactattgcatgaatacgggagttgctgtccatgactttatgaaattggactcagtggcgttaaaaaatgccgtgcctactgccgagggggctgtggcagaagctgtttttgactctcctgttcagatacagggaagccgctgtctggtgacaggcttcggacgatgcggcagcgtcctggcagaaaagctgaagctttggtcagccaaagtaacggcagccgcaagaaataaggagcagcgtgccctggcggagtcctttggaatgaaagcagtctctctcgatgagctgaaggaagagctttctcaggctgattttatttttaacacgattccggccatgattttagacagagaacgtctggaacaggtaaaaaaagaggcgttaatcgtggatattgcatctgcaccgggaggcgtggatttcagggcggcagacgaattggggatcaatgcaaaacaatgtcttggaattcccggcaagtatgcagcgtgttcagcagctgccattctgacagaaacaatgattacggaatgggatgtatgatgagtgtaaaaggaaagaaaataggaattgccgtaactggctcattctgcacatatgaaaaaatttttatccagcttaagaagctggcagaagaaggagcacaggtgcagaccattttttccggggccgcacagagcatagacagccgatttggaaaggcagaggatttcttagagagggcagagaagatcactgggattaccccgatgaaaacgattgcccaggcggaaccgatcggtccaaagagtcttctggatatcctggtgatcttcccgtgtacaggaaacacgcttgcaaagctgtgcagcgggatcacagattcaccggtcctgatggcggcaaaagcccatttaaggaacgataaacctttggtgatttctgtatcaaccaatgacgctctgggaataaatatgaagaacatcggagccctgatgaatatgaaaaatatttattttgtaccatttgggcaggatgatccggttaaaaaaccgaactccatgatcgccgataccagccttttgatcccgacggtggaaaaagcgctggaaggcagacaatatcagccggttatccggggatagaacgtaaggctcccggtgatgcttcaccgcggggcctgcatgaaaaatagttgaagaggtggcacatatgtgtggtattgcgggattttgtaatcctcataacaggtatctggaaaagaaagggcagtgggaggatattctgaaccgtatgaatcgggtacagaagcaccggggcccggatgatcagggaacgtttttggaaaacggatgcggcctggcccatgtccgtctctcgatcattgacttatacaccggtcatcagcccatggtcagagaggaatccggacgtaagtttgtcattgtgtataacggtgaaatttataacatgaaggaattgaaacaggagctgaaaaaggaaggggcgatcttcaggacagcgagcgatacggaagtgatcctggaggggtacatccttcacggaccggcctttgtggagaagctgaacggcatttttgcggtcagcatttgggattctgcggaaaagaagctgtttttgttcagagaccggcttggggtcaaaccgctgttttatgctttttccggccagacccttgtattttcatccgagatcaagggtatatttcagtacccggggatagaaccggtcatagacggggacggactcggtgagatttttggactgggaccggcaaaatcctatggaaaaggagtattcaaaggcatttcagaagtattgccgggtcattttcttgagtacagtacggaggggctgaaagatcacatctactggaagcttgagagccggcctcatgaagaatcttatgatcagacagtagagaaactgtcttatctggtccatgatgcggtaaagatgcagatgctctcagacatcccaatctgtacattcttatccggaggggtggacagcagtcttgtgacagccatctgtgccaaagagcttgacagacaggggaaacagctgaataccttttcttttgattttgtaaacaatgaccggtattttaaggccaattcttttcagccgtcccaggaccgcccttgggtagaccgcatggtagaggcatcgggaacgaatcacacttacctggaatgtaataacgagcagcagattgagaacctatacagcgccgtagacgcaagagaccttccctgcatggctgatgtggagtcttcccttctctatttctgttcgaaagtcgccgagacaaagaaggttactttgaccggagaatgtgcggatgagattttcggaggatacccgtggtttcataaaaaagagtgttttgaggcccatgcatttccgtggtctatggatatggagcccagggaggctctgttaagcgacgatgtgcttcaggcggtggatctgaaagcccatgcacggcgggcatatgaaaagacaatcggggaaaccccaaggctacttggagaagatccaacagaaagcaggaggagagagatctcttatcttaatcttaaatggtttatggtcacacttctggaccggatggaccgcaccagcatgtattccgggctggaagccagagtaccgtttgccgaccacagaatcgtggaatatatgtggaacgtgccgtgggaaatgaaatgtccgggtggtgtggtcaaaggcctgttaagggccgcgggcgaaggagacctcccaaatgaagtattatacaggaggaagagtccgtatccgaaaacttatcatcctgaatatgaaaaaatgctgggagaccggctgcgggaagtgatcgcagatccaaacgctccgatccgggatttgatcgataaaaagaaaacggaagaatttttagagagtccatcggactacggaaagccgtggtatggacagctgatggcaggaccgcagatggtggcgtttatgcttcaggtcaactactggctggaaacttatcatatcgctgttatataggaaaagaatagaagggattgtttttataaaagaacaattccttctgttttttttgctctatcatggtataatgtagataagatattggtcttagcaatcactttttatgagcaaaggagtgatgtttatgaaagagaacaggatcatatgtatttccagggaattcggaagcggaggccatgaattgggagaacatctgtcagagaagctggggatcaagctgttcgacagcgagatcataacaaaggtagctgaacttggcaatgtgcctgaagacttcgtggaagaacagggagaggccagagacttccgggggtttctgggggtgatgccggctggacatgttgcaacggacattacaagggattttgtagtcacttcggagaagctgtttgcccttcagtccattgccatccggcagatggcaaaagacgaaggctcctgtatttttgtgggacgatgcgcggatgttatcctgcagaatcaggcagagtgcatctcagtttttgtccacagtccgctcgaagacaggattcagagaattatggaactgcggcagatcacagaaaaggaagcagggaaactgatcaagaggactgaccgggagagagcctcttatcacaactattacacgaaaatcaagtggggacatccgagtaactatcacctggttcttaacatgggcaaactgggtatggaaaacgcagtggatctaatttcctattatgtagaacactgaacatgatacagagaggagagatgatatgagaccgaatacgatcatatgtatttccagggagtacgggagcggaggccatgaaattgcggagaagctttcagaagatctgggtataaagttttttgacaaagagctgatcgccagagtggctaagatggcggacgtatcggaagaatatatcagccgcagggaagaaaccggtgactatgcatatattttcggggtacccattgggcacccagccacgacaccgatggatgaatgtatcctgacacctgagaagctttttatcatccagtccattgccatccgccagatcgcagagcaggagaagtcctgcatctttgtggggaggtgtgcggatgttatccttcagaaaattcccggctgccactcttttttcatccacagctctgaggcagtgcggattcagaggatcatggagacggagaacgtctctgagagggaggcgaaacgtctcatgaaaaaggtggataaggagagggcttcttaccacaactactacacaaaaatcaagtggggacatccgagcaattatgaactggtcatcaacaccggccggacaggcatagacaaagcggtaaaagtcatagaatcttatttagaagaatagatataaagggcagatggagaaatgatccacctgtcctttttaagccgatggagggcagtttgtaaggccgtcttctgcggcagacactatatccattttctacatgactggagcgaggcattctaagagccgaacggaaattatgtggaatatgtctctcgggtggacgcgctttgcgcgataaggtataatataacaagtagcaggaagatgtttttactggataagggaggttgtatgattatggaatataaagatttgattgaaagcaagaactccgtcagggattataaagagaaggaagtcgatgccggtacaattaagaagatccgggattttgcccagtcctgtgagcgtctggatgacagtattgagatcgatattcggttcatggataatgataccgtttaccgccagctggatgggtatgcagggtataaagggattttgatcaatgcgccgcattatatgatcgttttgtcagagaaaaaggatcattatattgaaaacggcggatatgtgggtgaatctatctctgttaaagctcattctctgggagtggattcctgctggattacttttaaagacagccatacagtcattgaaaagctgaacattgtcacggataaagaagtggtggcgatcatggcattaggatacggaaagaagcggtttaaaaaggttacagggaatgtcacactgggaaaaggatatgccaatgcggatttccaggtgaaagacagcgttacatccccaaggatgcctttagaagagatcgtttttattgatacatgggataataaggcaacagtggatgagcttgtgagccgggctgtttatgaaccgttaaattatgcaagaatggcgccttctactttgaaccgccagccgtggagattcattattgacggcggactgctgatccttacggtcagggacgatgaggagaccaatctctacgaagaacaaatcgatgcgggcattgtcatgctttactgcaaaaaggtgatgagggagaccttatgtgagatcagctggaatctcgagcctgtggaaaataaatacaatataccagataactataagattgtggcatcctgcagtatgtaataccctaaaagtcggaaaacggaaactgaaatccaacggttcctataagttttatgtaagaccatatcaaaatgtgaacaaaaagaaaaagaacattggaaaatctaatacggcacatgtattgatgagggctagttcccagtatgcaaatgcatcctctgtctctgtaaagaagagatcaatgaaacttcaaaagggaaagacagccgttattaaagcgaaggtcaaagtcccgtctggcaggaaacagccgaaaaatcacggtgcaaaatacgttacattacatcaaaaggttctgtggcagcagtaaataataagggaaagatcagggcaaagaaagccggtaaggcaacaatttatgtgatcagtgaaaatggaaagtataaaaaggtcagcgtaacggtaaaataaaaaaatgctgaaagaaaatgttgtaaaactaaataggacagttttacaacattttttattcggcatacaagaacaaaagaaattaaaaaaaatataaaaaaccattgcgcttgtcgaaattccgtggtatattaataaagctgttgggctatcgccaagtggtaaggcacaggattctgactcctgcatccgctggttcgaatccagctagcccagttccatcagaattaaaaataacataatcagggtgtgtagctcaggtggtagagcacttgacttttaatcaagttgtccggggttcgaatccccgcacgctcagttccgaatcaggaagtcacagacgaagatctgcctcatattttttggaaaatcagtaaaaaagtagttgacataagatttttgctgtgatatattgataaagctgttgggctatcgccaagtggtaaggcacaggattctgactcctgcatccgctggttcgaatccagctagcccagttccatcagaattaaaataacataatcagggtgtgtagctcaggtggtagagcacttgacttttaatcaagttgtccggggttcgaatccccgcacgctcataggactccgtttcagatgaaacggagttttttcatttcataggaaagttctgcgaccttccctatgaaataaaaacgctccgcgggttgtgcacagatgcgtaaggaaattatttgcctgcggcaaattgcatcaggcacgcaaagttgtcaagccccctcaaagattgaggggcctaagaactgaagtgggcttgcaactttgttttttttttttttttctgaacatttttcttttaccaggaggtattccaatgaaaatagaccgtttaatcggaatcatcacacttttactcagaaacgacagagttacggcgccggaatccgcatcgcagaaggctataagcttgacaaaactgtttttacgaaagaagagctgagagcagtttttgaagggctgaaaggaattgacagcgtatcggggacttccgctgcgttaagtctcatggaaaagctctctttagaaccggaagattcggttctgtcagaaggaatgatcctgatcgatctggcttctcactatgaagaatcactgaaagagaaaatcgggatcataaaacatgcggtttccagtcggcatacggtgaattttttgtattattacggcaaaggagaagaataccgagagatcgctcaaagagacagaaaacagttttttggtgagaaaagcaggtagaacggagacggattttcaggactatttcagacagaatgcagtcagactgagagcggtctttgaaaaggaagcaaaatacaggcttgtggaagaatacggggtcggatgttatacagaagataagcagggccgtctgatttttgaatgggatttcgtaaattatgataacatgaagcagtgggttttgagttttggaagccaggcaatggtcatggaacccaaatgcctggcggatgatcttgtatcggaactgaagaagaatttaaacagatatacaggaacatgacataaagctgtccggttccttctgatatactgaatgtattcaaagaaggaggaagtactatgttaaaaatgacagcagcaggattatttgtcagctatccggaaaaaataaatgggacggtggagcttgcctttgatctgccttcctataaagatgtggaccgggagtatcagagagtgctggaagccggtgctcgcaccggtaacggaaccgtggggacagaggacaagctacgttgcagaccctgacgggaatctcatcgagatcggatcttttggaaaaaagtgatgaaatcataaaaatcctattgacaaatcgaaaaaaaacgtgtaagattccaaataacctataggtacgataggaaatcagcaagaaggagataccgctatgaattttatcaaggcatataagaatttcatgatggatatgatgggtatgggaatgcagatgcagagcatgtgcagttcttttgtgtacaatcgaataccggaacatcatatttgtatggagatatcttagatgccgagaaaagaatagaacggttgattataaggaggcccatgcatggcctcctttttttgtgcttctgaagatattatgccggttccctaaaacatgaaaacgctccatgtctgaacggccgcagactgagctaaagtttgaaattaataattccatactgaaaaaataggatttgtataaaaatggaggaacgtattatgaaaaaatcgttgaaaaagctgacaggaatcgttatgattggagtattggcactgggtgctttgaccggctgcgggagaagaaatgccagcgctgcaaaagatatcaccatcggtgtatgtgccggaccatacggggacatggttaaaaaagcgatcgcgccttctttggagaaaaagggctacaaagtatcggtgagagagttcagtgattatgtactgccggatcaggccctggcaaacggtgagatcgatgcaaatttaatgcagcacacggcatatttagaaaagtttgcggcagataatgatctgagaatcagcaaagtcattgcggtgccgactgcaggagcaggaattttttctgacagcatcaaatctttgaaagaactgaaaaagggtgacaagatcgggataccgaacgatccttctaacctggcaagggctcttggcattcttgacaaagaaaagatcattactttaaagaaaaacatcgatcagacaaaggcttcggaaaaggatatcgcccaaaatcctaaaaaactaaagcttataactttggatgccgctcagatatcaaggagcctggacagtcttgcggcgggtgtagttcccggaaattatgcatatgcggcaaaactggatttttccaaggcattggcagtcgagaccttggcggaagaatataaaaatgtcattgccgtaaaagctgacgatgtgaaaggacagctgggaaaagacctcaaagaggctgtggagtcagaagatttttataaagcagtgtcagacaaaaagagcagctttaagtccttccagaaaccagactggtggacagaaaaatacaaagaaaaataaacttaaaagagaaaggtgagaaactgtgattgaattaaagaatattggagtgacatttcagcagaataaaaaggattttcaggcggttaaaaatgtgaatctgaccattgaggaaggagaaatctttggtattgtagggcccagcggagccggcaagagcacgcttgtcagggtgatcaatctgcttcagccgcctacctccggacaggtactgatcgaagggaatgaaatcacttccctgaaaagaaaagagctgtgtaaggtccgtctggacatcggaatgatcttccagcactttaatttgatcagcggttccacgatcgcagaaaatgtggcgtttgctctccatgcaaaccattatccgaaagagaaaatacagggaagagtaaaagaactcctcgaaatggtacatctgcctgaaaaagcggattcctatccggccaacttaagcggcgggcagaaacagagagtggcgatcgcgagagcgctggcaaacgatccgaagatcctgctctgtgatgaggcgacatctgcactggatttggagaatacagaagaaatcgtggctctgttaaaagagatcaatgaaaaatatcatatcaccatagttttcatcacacatgagatggaagttgcaaaaaaattatttgacaggattgcattcatggagaacggagaaatcaaggaagtacgggatatttattctgcatttgcagagccgagagaagagattaccaaaagtcttgtggagcgggtgctcaatgtgggcgttcctgatgaggtgaagctgtcggaggaagaggaactcgtgaaactctgttataccggagaaaaggcttatgcctctgtgatcagccaggtttccaagcaatttgacgtggtgatcgatatcatcaacggaaagatcgactatattcataagaaaccattgggtgtgctgattgtgatcttgagaggcggaaaagaagaacgggaaaaagctcttcgttatatgaaagaaaatgtgtaccgcgtagaaaaattagagggaggacggtaagatgaaggaaacgatggagattataaaattagaatttggaaatgcaacagtagagaccatacagatggtactgatcgccatggcagcagccgttgtattcggaatgctgatcgggctggtgctgcatttgacggctaatcccctgtttttcaagaaccgggcagtcaatgcggtggcaggtacaattataaatattatccgttccatgccgtttattattctgctcgtagtactcctgccgctgacaagaatcttagtaggtaccagcattggtgcggcagcggcggcggttcctctttcaatcgcatctgtagcattttatgcgagattggtggaaggatctttcagtgaagtggacaaaggagtcgtggaggcagcggtggctacgggggcaagtgtttccctgatcatccgcaaggttctgtttgtggaagctcttccgagtctgatccgtggacttacggtgacatttgtaagcatcatcggttactctgccatggcaggaagcgtcggaggaggcgggatcggagacttggcgatccggtacggatacaaccggtatgagaccggtgtcctgacctttacagtaatcgtattgatcttcattgtccagctcgggcagtggctcggagataaggtagcattaaaatttacgaaacggtaggtgatgactttgaacggacttgaaagtttgatccccgacagcaggcgggtgatctttgactctgatatagaagaaaaatatttatcggacactctgggaaggctcaagggccgggcaaaagcgctggtatttcctgagtctgtaagagaggtcagcgatattatgaaatacgcatatgatcataagattccggttacaccgagaggagcagggaccaatcttgtaggttctacggtaccggcggacggagggatcgttttggatctgtcccgcatgaatcgggtgctggagattgataaggatacttttacggcaacggtggaacccggtgtagtgctgaaagattttcaggagctggtggagcaggaaggcttgttttaccctccggacccgggcgagaagacagcgaccatcggtggaaatatcagcaccaatgcaggaggaatgcgcgccgtaaaatacggtgtcaccagagattatatccgtggattggaagtagtgttggccgacggcagtgtggcagagcttggcggtaaagtcgtaaaagacagttctggtctttccctgaaacatctgatgatcggctcagagggaaccctcggagtaatcacaaaggccattgtgaagcttatagcaaaacctcaggagtcattgagtgttcttctgccttttaatgatctccatacgggtatccgggcggtcttaaacgtgatacggggtaatctggacccgacagctattgaatttgtggagaagaaagtagttgcattgggagaagaatacgttggtcttgcttttccttatcaagatgcagcggcatatattcttctgacctttgacggagacgacttggaggaaatttataaacgggtcgaaaaactgagaataatcgccaaagaaagcggagctaaggacgcgctcgtgctgagagacggagagacgattgatacggtgtggaaaatacggggagcccttgtaaaagccgtggaggcaaaatcggaacaggagccggtggacattgtggttcccatcaataaatcagctgaattcatagaatatatcaatgatttagaacagaaaaccggagttcaaatggtaagtttcggacatgcgggagacgggaatgtacacctttgtgttgtccggggcggcaggacacaggagcagtgggaaaaagaccggaaagaagtactggcttcggcctacgataaaagcagtgagcttggcggcctgacgtcaggagaacacgggatcgggctgagcaagaaaaaatatttaaaaaaagcagcagatcctttaaaccttcagatgatgaagcaggtgaagctttccctggacccgaaaaatattttaaatccaaataaaatttttgattaagagttttttaccaatattttcgtcacgctttgaaatgcgttcctccaatattgataaaaacctgtcacaaaatttgttaaggtatattttccttttcattggaaacaatagtggtatcaaataattattccaaaggaaaaggagagttcataatgaaaaagaaatgttggatgcttacaatggttgcagtcctcacattaagtgtcgctgcgatgtttacaggatgctcaaacaaaaatgatgctacaacaacagaaaaaaccacagaaggcggttcatccactacagcaacaaacaatgatttgggtgacgacgtggaagatgcggctgatgatgtggcagacggagcaaaagacctggcggacgatgtagccaatggatttgatgattatgatgatgcccatgactatctgatcaataaacttagttctgatggagacggtcagtatgaagtaagaaataaagacaaaaatgtcatagagtacagagatggggcaaaaggttaccactttgaaatttatgacacatccaaagactccggtaaaaaatacggtgatttctacgtcgacaaagacaacggaaaaatctataagaaaaatactgatacaaaaaaagtagaagaatacaaagcaaataaataattcccatgaaaaatccttgtgtgcagaggctgtttagatcagactcggcgttcagggatttttttgagcccagagccattgttgcaattcttacagtgaggtgatagaatgatatctaaaactttgatgggagggaaagtagtatatgatgaagtacagtgaacttaaagcagatctcatgggtatgtttgacgaaaaaaaactgcagatgcttccgcaggaatgggggttttttaatgaattcgagagagaaattaaaactatcgggtatgcagtaaatctgacagaggcactcatagaaaaagcctgtcagaaacagatagagtttctcgtgacccatcatgattcatgggaatttatttttggactgaaagaaagctgcaatcaaatcttagaaaaaaacggaattacccatgcttattttcatgcgccgttagatgatgcggagtttggaaccagtgcgtcactggcaaaagcacttgggatgagaggccttgaaaaagtgatgccatatgcagatatctattacggcggggtgacaggtgaggtcgagcccgttgatttcaatgtgttcagtgaaatgctgaccgatattcttaaggaacaagtgcgctgttaccagaataatgcaaacccggtaagaaaagtggcagtggctgcaggcggaggcaacatgacaacagaaatgagaatagctgcagaggccggatgtgatacatatgtcacaggggagtacgtgctctattcacagcaatacgcacagcatgtgggaatgaacctgtttgtgggaagtcatacgaatacggaaatcttgggagtggaatcgttggttcaaaaaatagccggggataaagaaatccggattataaaaattgatgagccgaattattaaaaggggtcttctcaaaatcggtcaatggatttatgctgtctgtctgcctgatgaatggatgaaggctgcagggccatttttggcccggaaaggacatgtcaaatctattttacatgctgaaaaaacgaggatgtcaaacacttttgatagaaaatctgaatctcaatcgatataatgtcgatacaacataaaacacaagcaggaggaatcagaaaatggagttcagcaaacaaataaagaaatacaggcttgattcaaatctctcacaggatgaattggcagagaaggtatacgtcacacggcagacaatttcaaattgggaaaacggtaagaactatcccgacgtaaaaagtctgcttctgctgagcactctttttcatatttctcttgataccttagtgaaaggagatttggaagagatgagagaacagattaaagcagaggatattaaaaaatggaatcgtgacagtttcatcttcggtttgcttctcgtagcaacagcagtgctggcagtaccgctttctttctatggagacgtggtcggaatcgtgatctggttagtgattttcggctgtgcaatttattatgcaagccgcgttgagaaacagaagaagacacatgatattcagacgtataaagagatcatggcttttacggaaggaaaaaaactcgatgaaatagagaaataccgggagtccggaaaacggccgtatcagaaattactgttggcagtctgcgcaggactgctgacattggcagtttcagcggcaatgatctttctagtacaatagggaagtttcataaatttttctaaaagaattgttcaatttcccaaccggtaaattctatgagtacgtagaaaccgcataaaactgcgggttagagatcatttttaagacaaaactgaaaaactgctgccggttgggaaaaaataagggaaacgttgattttatcagggaaaatgactataatgaaaataaagaatggcggaaatacgttggataaacaataacaagagttgtattgaaatatcgcaccgagagtagcaaactcatttgccagtgttgataaacaataacaagagttgtattgaaattaaacatctttaaatgttaaatttgaaacttttacagataaacaataacaagagttgtattgaaatctggattttttcaggcaattgcaatcgcagtatctgataaacaataacaagagttgtattgaaattgagcgaatatcgcttgtagctccggggataacttgataaacaataacaagagttgtattgaaatcattccattatacacggaagttcttcgttctctattgataaacaataacaagagttgtattgaaataggcatctgtaaatgataccgggcaaaggcaggaaggataaacaataacaagagttgtattgaaatacaaatcctgcatatgaacctatgtatttttcaaacgataaacaataacaagagttgtattgaaattaacatgggaggattatgcaatgaatcatatagagataaacaataacaagagttgtattgaaattgttatcaatgccattcccggtaatctggtggttagataaacaataacaagagttgtattgaaattttccacaagttttctcaaccgtttttttgcattatgataaacaataacaagagttgtattgaaatttgcatttaatttatgatccctgatcggatattcgataaacaataacaagagttgaatattgaagcctctcgttttttacttttacattataactgctattatggttaagagaatttgtcttactgcccttgaacaaagtgtaattacagtttacaggagggaagtgcgcaacaatgatatcatttttaatatggttatttataggtctttcatttattattcttggcatttatgctttcaacgcaaagaaggaagttgcgtttggcttttgggcgaatgcagaagttttttctgtaaataatgtaaaatcatataaccgcgcgatgggtaaattatggtgtgtgttcggtttaattctaattgttttggggctgccccttttaaaaaagcaaaattctccatttattctgttttcaagtttagaagtcatggcagaggctattgtgactatggctgtctatgtgacagtgatagagaaaaaatatcgtaagaaatgaatatcccatagctacttaatccggcatgtccggatttttattttgtacatctttataatgctttttaattgagaaattgtttcagtcaaaaactgaaattgctggacaggccgtacttcagtaaataacatatcagatcaccccaaaataaggctgttttcttttttttcttatgtagtataataggactgtaattatcagacaaatttgcggaaaggatggacgcaatgggacttaccctttattaccggaaagaaaagagaggtcttaaactgatccgctgttatggaaatgacggcattgtatcatttccggacactgtgggcggacagccttttaaaatactaggagactatgcattttcccagtggaagaaacaggaagaggaagatgtagaaatatatgacgtaacagataacaaattttttgacgataaaagtgaactgctctgcgggaacatgattgaaatggtatatttacctaatgaaatagaggaactgggtaaatatgctttctacggatgcagcaatcttaaaaaactgactttttcagatgcactgaaagtcaccggaaccggagtgtttaacggatgcaggctccgtcatgtggagattttctgcaataaagggaaaagcacgtgtcttaaagatatcgtcggagaaatacgatatgagctgtatgccgacctgcattactgtacagaagctgggcccgtaaagacagcaaagctggtctttcccgaattttatgaagaggcggtagaaaatactccggcaaggatcattgagaaatattttaatgggtcgggctataagtatcgtcagtgctttcagaaaagggaagtggactatcaggcctatgaccagctgttttccgttgcagtgatagaagaacggccggagctggtatcggaaattgccgtccgacggctcagatatccatatgaactgagtgaaaaagcaaaaaaagagtatacaacatatgtaaaagaccgtgcaaagaatattgcaaaaggatttgtcaaacaacgtgatatggaagcactgcggttcttatctaaggagggtctctggaatgagaaggcgatggaagcggctatagagcaggcatcctcacagaaagacggagaaatcatgagttttctgatgaatgaaaagcagcgcctgtttcctccgaaaaagaaaatttttgagttatagttaggagaaatatgcagaaagaaacagaaaaagcagagaggcttgccgaagccggaaagcagatcctcatggcttcaagagatgaactttatctgcacatgaggttcatggatctggcattgagcagctttttttatatatgccatgcagacgcagagagaatcgcctctgacggcagggttatatactttcatcaggggtatctggcaaagttgtatgcacaggacagaagaatggtgaaccggatgtatctccatttggtactgcactgcctttttcatcatctgaccggacagaaaaacagggaaaaagaattgtgggacatcagctgtgatattgctgtcgaatccgtgatcgaccagtggaagaccgcgtcggtttctttatatggaactgtgttccgaaaagatatttataaacgtctcaggaaagaactgaaggtgctgacggcggaaggcatctacaaaaggatcaaggaatgggagcctacagaacaggaaataaagcgcatcggggaagagtttgtcatggacagccacagcttctggccgacgaaagaccagccaaagatgcagcaggagatccggaaccagtggcaggacatcagtgaaaagatggaactggatatggagacattttcccaggagatgtctgcggacgcgggagatatggtccggcagatgcagatcgaaaacagggagaggtatgattaccgggaatttctgaaaaaatttgcggtgcttaaagaggaaatcggtgtggacgaggattcttttgactatgtgttctacacctacgggcttcgtatgtacggaaacatgccgttagtggagccacaggagtggaaagaagtaaaaaaagtagaagaatttgcgatcgtcattgatacctccatgtcctgttccggtgaactggtaaagaagtttttggaagagacctatggcattttaaaggaagaagaaacatttcttaaaaaggtcaacatccatatcattcaatgtgatgaaaaaatccagaaagataaaaagatccgtgataaaaaagagctgaaagaatatatggaacatttggagctcaaaggggaaggcggtacagacttccgcccggcatttgagtatatagtaaagctcatggaagaaggagaattttacagtctcaagggagttttgtattttacagacgggcaggggatttatccgaagaaaaagccgccgtttgagactgcttttattttcatggaagaagaatacgaggatgcccacgtaccgccgtgggcgatgaaactgattgtttgcgaagaagagtttgaaggagaagattatggacattaaacgtgcgaaacaggaaattaaagattctgtggaagcgtatttaaataaaaatgagtacggggaataccggataccggcgttgagacagaggccgattcttttgatggggcctcccgggatcggaaagacacagattatggaacagattgcaaaggaatgcggcattgggctggtagcttatacgatcacccatcacacaagacagagtgccgttgggcttccgttcattaaagaaaaaacctatggagatgtcacatattccgtgacagagtatactatgagcgagatcatagcttcggtatatgaaaaaatagaacagaccggtcttgaggagggcatcttattcattgatgagatcaactgcgtctctgagacgctggcgcccaccatgctgcagtttttgcagtgcaagacctttggaaatcagaaggtaccggagggatgggtcatcgtggcggccgggaatccaccggaatacaataagtctgtcagggagtttgatgtggtgacattggacaggatcaaactgatcgatgtggaagcagactatgatgtctggaaggaatatgcatatagagcaggaatccatcccgctgtcatggcttaccttgagatccggaaaaatcatttttacaggatggagacaacagtagacggaaaagcctttgtgactgccaggggatgggaggatttgtccgactttatgaaggcgtacgaaggacttggaaaaactgttgatcgggatgtgatttatcagtatatccggcatttagggattgccaaagagtttgcaaattatttggaactttacagaaaatacagaaaggactataaaattgacgagatcctcgagggttctttcacggaagacatgctggagaaactgaaatttgctccgtttgacgagcggctcagcattgtccatctgctgaacggaaaattaaatgagtttttcatggaatatgcgaaaacagatgcctatgtaagcgagcttttttcatggctgaaagactacatggagcatgagtctatgcaggaaacacataaaaaagctgagtcagaatttcagaagagaaagaaagccgagcagattgcgaaggaggaagaacatatatggaagaaggtcatcgggagactggaaacttaccttgaaaatttgaagaaagagaaaccgcaggatgagccgaaagcggttcgaagctggtttaaagcagagacagaaagcagggagcagctggtggagaagatatcggatgcccttctttatgcctttgatttcatggaggcagccttcggggacggacaggaaatggtggtctttgtcacggagctgaatgtgaattattacagtgtccgatttattaaagaaaacggctgtgatccttattataaatataataaaggcctcctttttgacgaaagacaggaagggattcttgaacagatcaaagatgcggtgagataaggattttagatttacaaagacctgaaagcaagttaaactagagatataaagcaatggaagacagccgggaaagtgcagaacagatcagcagttatgcagaggaaaggagcctttttatgaacaaagatttaaaatatgagaattatctgacacagccgaattcactcccttttgaggaagctatggagatttatgaggcaatccttcagaattcgccggaggatgacgaagagtttgaagaattttgggaattggctctgagtgcaatgactgtctatgcggacctccgggcaaattggaagcagatcaggaaaggtcagcgggacaatgacggaaggacgagaaagcatgataatgtcatacacacattgaatcttctgagcggcatgatggagcagagagggctggatgtttcatggaggaagcagctcggtgaccagagaaaacggattggcgattttgcctgctatgtagcgatgctttacggcttatctgcgcgctagaaaggaaatgtaacatggaaataaagataaccttgggtgatatcacaaaggttccggcagatgccatcgtcaatgccgccaatccgacgcttttgggcggagggggtgtggacggtgccatccatgcggcggccggacccgaacttttggcggagtgccgcaccttgggcggatgtgataccggagatgcgaagattacgaaagcgtacagacttcctgcacaatatgtgattcacacgcccggaccggtgtggagagacggggatgactgtgaggaagaacttttagctgactgctacaaaagctgtcttaagctggccgcagagcatggatgcaggcatgtgacctttccgtccatcagcacgggcctgttccggtttccgctttcaaaggctgcgccgattgcggtgaggaccataaaagaattctgcggaaacaaagatatttttgactgcattgaattcgtctgtttcgacgaaaagacaaaaaaagcatatgaaactgcgctggaggattaaacaccggcagtatgttccgggagaaggcggaccattctcttttcagaagaaaggatgccgtcttctttcatttttttcagttcccgcatcattgcgctccggtctatggacagataatccgccaaatctgacatggtaaacgggatatgaaaagaactggatttctgccgcagggattcctgcatgaaataacaatatagcttttcacggatggtgcgcttgctcaaaacctcgactctctggctgagactcatagttttttgagatatcagccaggtgacattctggatcagccggatatggcaggcacaggcattagtgcagggcttcatgagagactcataatcgatcatgagtaccctgcattcggtatcacacttcaggtgaatatcttcatactcttcagaatgaaaagccagaatttcaccaaatacactgtttgtctccagcttctctaaaatggtccggcttccgttgaattcatagcgcaggacggaagcagtgccggagagaagaatgcccatgacaggtttttgagaagaaaaatgatggatcatttcaccggaagaaaacagtttttcctctgagtgaaaacagttcagcatttccaggcagtccctggatgtgatatctgtgaacagcggattttcattgtactgcataaaaaaacctcctttttttaaatatggcatataaatgttgcaaatgcaacagtaaaaatcatgggcagcatggtatacttacgtcacagatgaaagataatatgataccagggtcaaaagggcatgcgtttcatgcttgtatgaaaaagcagggctttgggacccataaaacatgagaaagcagcccgattagggcggatttcgaatgtttttaggattgtgggagcacaaagtgcggaacaatccgctggtatctgggggtcaaaatactttttgacccttacatcacaatatgaataagttaatagatggaggtaacaacaatgaaaaaatatctttgcgaaccatgcggctatgaatacgatccggcagaaggtgatccgagtcagggaatcgaaccgggaacagcttttgaggatcttccggaagattgggtctgcccgatctgcggccttggaaaagatgtatttgtagaagcttaaatttttctttagtatagtactcattataaccggagttgaaaacgtcccgcagatatttgcgggacgtttttttgctcaggagctgtatgccgcctttcaggcccctattgtcctgctgaaaaaatgtgatataatagacagcaacatacattctatgaatgttgggaggaaggaacatggcaaaaaaagagccgaagaccaatgcgatgaggattttggagaaagaaaaaatcaggtttgagatccatcgctacgaatgtgaagaatttactgacggggtggccattgcggatatgcttggacagccctatgataaggtgtttaagacgctggtcacggagggaaagagcaggcaatattttgtgtttgtcattcccattgccgaggagctggacttaaaaaaggcagctaaagccgtgggcgaaaaatcagtggaaatgattcacgtaaaggatataaacaaagtcacaggctacataagaggcggctgtaccgccatagggatgaaaaaggcctaccgcactgtggtggatgagagcgtgaagaatctggagacacttatcgtcagcggcggaaagcggggaacacaggtggagcttaatcctgcagattatttgagagcctgtaagggaagcacggcggatttgataaaagacaagagaggacgaaaaaatgattgaagatattttggaatataacaaggtatttgtgaaaaataagatgtatgaacagtacaagacaagcaaatatccggacaaaaagattgcgatcttaacctgtatggataccaggcttacggaactgcttccggcagcccttggtttaaaaaacggggatgtaaagatcattaaaaatgcaggaggagtcaccaatcatttgtttggaagtgtggtgagaagtcttttaatcgcagtctatgaattggggatcgaggaggtcatggtcatcggccatacagactgcggtgttgggcatatgaacagcgatggcatgatccagcacatgatcgaccgggggatagaagaagacaagattaatttcatcagacactgcggcattgattttgattcctggcttgcaggatttgactgtgtttccgactctgtcaatgagactgtggaacttctgcgcacgcatccgctgattccggacgacattaagatattcgggtatgtgatgaatacggataccggagagattatgacaacagaagaattcaaaggagaataatacatgattcagtgtgtatttgtaggtctgggaggatttctcggcgcagtcttccgctatcttcttgggttgatcccggtatcggcgcagataaggattcctgtggtcactttggggattaatgtgctgggagcatttgtgattggcatgatcgccgggtggacgggaaagataccggcccaaaatcccaatctgatcctgtttttaaagactggactctgcggaggattcactacattttctacgtttgctcttgagacagggacccttgtctcagagggaagagtgagtgaaggtattttatatgtcgtactgagtgtgctgttttctgtccttgtggtttttgctggacgggccgttgcaggatgagaaccaaaagtttgcatatactatcccaaaggagggatggttatgactaaaaccaaaaagtttatccttggaggcattctgtttacggctgtggtgggcagcctctggcattttatctatgactggattggaagatcggaatttctctggtggttgtttccggtcagcgaaaaagtggaggagcactataagcttttaatttatccgaatctgatctacggccttctgatgtttcggtttatgtacaggcatatcagatattactggctccgcctggccgtggggaccggtttgggctgtgtggctatcagaggattgtttgacgcatataccgccgtgttaaagaaagatatgctgatcatggatttattcgtatttgccgtcagtatattggtatcctatgcattcttcttaaaaaggagttaaaggaggtgcctgcttatgaagctgtattattgtgaccgggagcaggggacagagacgttgattgccgaagcgcaggaagataaagaaatatggagagccatggaacgctggttgacggaacatggctttgggctgatttatgtgattcatcatattgaaaaacaaaagatttattacgaatttggaaaagaacactgcttttttttggttgtgacataagtaaggaggaaaagaaatgctgccgaatgatccggtgatactgttaagctacatcaacacacagctcagggactattatgacagtttcgaggaactgtgcaagagtctgtgtgtggactcaggggagatcagtgcaaaactttcgggtatcggttatgaatatcatcctgagacaaatcaatttagatagtggagaataaaggctgccggatgggcggcttttattggttttcccaacctgaaaaagatacgaaatgccgggagaccgcttaaaatggcggttggtagccggtttgaaagaaaataccggaaaaacagaaacggttgggaaaaattcagagaaacgttgaatttatcaggaaaaatgactataatggaaataaggaatggcggaaatacgttggataaataaaaacaagtgttgtattgaaattccttaaacacaatggaatgagggacgctgaccagataaataaaaacaagtgttgtattgaaattttgataaattttgtattttagtttttacattttcgataaataaaaacaagtgttgtattgaaatcatttttaaatgcaagttccagcgtcatcatgtggataaataaaaacaagtgttgtattgaaatttttggattgagaacgatactcatacgtttgaaaatgataaataaaaacaagtgttgtattgaaattcctcttcctctttcccttctacgagaagttttgtagataaataaaaacaagtgttgtattgaaatagcccttcaccgcctaattgagaaataatatctggataaataaaaacaagtgttgtattgaaatttgcgcaattcacgcattccactccaaactcaaatgataaataaaaacaagtgttgtattgaaatcgtaatccaaaggtatcacaacgcatcttaaagcgggataaataaaaacaagtgttgtattgaaatgtcaggtcggttgtcattttggaatgatcttgtgagataaataaaaacaagtgttgtattgaaataagaaaatccatggccatgagaaccggcattttcatgataaataaaaacaagtgttgtattgaaattccggattgcttcgagtttttgttccggtgtcagagataaataaaaacaagtgttgtattgaaattaatacgatcggtcaatatcggattctttacctagtgataaataaaaacaagtgttgtattgaaatattggcttatcatcttctttatataaccaatcctcgataaataaaaacaagtgttgtattgaaatttctttatatattcatatttttagagtatttaatgataaataaaaacaagtgttgtattgaaattacaatgcataaaaaaagtttgcctgtagaaacaagataaataaaaacaagtgttggtcctatgtcaagatttagtacaagttaaaagagactataaaaaagtctgtaaataagattcttcgatgataatgaagggcgaaagtcttgaacaacaggcttttcgcccctgctttatatataacagttacaaaaaacatgtcaacagcaggcggtaaatccgcccgtttttaggccgtctttgaattaatctggaagtcgtccctcgtacatgatgcgtaactccccatacacctgtgcccagttccgcatcgttaccgtccatttctttgtagcctcaaatgtcgctaaatacagtgctttcagcagcgccgtatcacttgggaatacgcttctctggcggctcagcttccgataagtggagttcagtgattcaatggcatcggtagtgtatatcaccttcctgacggttgctgaaaacttgaagattggagaaacagcatcccagttgtccttccagcgtttcatcgaattcggatatttgggtgcccatttctctgtcacacgctcaagggctgcaagggccttctttattccggtaagaccatccgcacagatgataaggatgtcttttacaccccagtttttcagctcattcaaaacagacagccagtattttgaactttcattctctccaacatggattgtaagtacctctttcttcccttccgcattaatcccaagaatgacataggcggcaagtttacggatcacgccattgtcacggacagaatagtggatggcatcaatataaaggattggatagacttcatccagcggccggttttgccagtcttccatctggggcaggatcttgtctgtgacatcagagataaatcctttcgaggtttcaaagccgtagatctcctccatggtttctgatatctgccgggtcgtcattccttttgcatacatggaaatgatcttttggtcaatatcagaaatgtctttctgccgtttttcaccacttgtggttcaaaagtagatttccgatcttgcccttgatggttccgccaaggagagcttttagggcatcttgaatgtcttcagcaatttggatatcgtattcctccaggcgctgatggattatgctgcgtttcccttccgtcatttgtactctgtgtacgggtttcttttctcttgccataataaaaggccctcctatgatttttattttatcatagaagaaccttctaagttctattttacagaaaaagtttcacactctcagttaaaatgagaaatttatcctcatcttaacttgtactaaatcttgacataggaccagtttgattgccttacgaaaaaagtcattaaaggagcagcgttgaagtataaacgtgatatttcaagacgcttgcaacatgaagtcccattctctgaaatttcggatttggaattgaataaggctggcatttatgacagatattccagcgattatacagcgttcaatcttcttggcatggaagtccaagtatcggacgaccagttaagcaaagcactcaaatgtttaccagagaaaaaacgcaatatcattttgttgtcatactttatggatatgtctgacgcagaaatcggagagcttataaacgtgttacgcaccactgtttaccgtcacaggacaagtattctggaagaattaagaaaaatgatggaggaataaccgcggataacaaccaaagacacataccctttgctgtgattgtggcggctaccgatggtgatgaagctgccatacagaaaatcttaaaattctatgatgggtacatatcaaagttgagcttacaccagttgtatgacgaatatgaaaacgtctacatggtggtgggttctgaattgaaaggcagaatacaggcggcggtcatggatatgattgcaaactttgagattattgtaatttaaccattctgatgggcggagccccctttttttgctccacttgtcaatctatgaatgtccattattcagatagtggtttttcatagactggcaatcacagtcaagagttctttgacaactgaataaagcagatagatacgttcgatatgcagcgagccagcggaaattgcacgccatgaccttttgagataaagtgagcgattcctgtaatgttccgcaggcaactgttggaaaggttgcagctatgacctgtatatctggataatgatacacccgtatgacacggttcacccatcagaatgggaaaggtgaaagtcctgtggagcttgccagagtaaaaaatcattgattctctggtcgtaatatgatgaaaaaagccgaaaatatggtataatatacatatatcgtattacggctcattccagtatggaaaggagctttatatcatgtcagagaaaagacggaagatacgcatacaaatacatggacgcaaacggtaaaccgcaattcgtgtacgtttggaaattaactgctgaggactgactgacaatctggattttgaaatcaggataatcaatgtagaccatcagctattgaaagattcgcaggttggctactacgttgaaactccaaaaacaaaaaacgtcggtaaagcccataaatacaggctaaaccgacatttgccaacttatgaaaagataatcaaaaatttatatagtttttaagaagcaacaatgtaggaaaaagcctaaaaataaggatttagtgtttgacataatgggaagaaaatcagttagacaggaatatatgaaaagtgaccaaaatacctaagggatttttgtataaattcatacttgcatatggataaaaaatttgttattatatcgctgttgaaaaaagaatagctatggctgttactggtaatgcaggcaagaccaagtttggaatagagtcttagataaggctttattgctgcttggtctttttttgtataaacgagtccgcggttgtttatacagagaggaaaaaagaaaaggagagtttttatggattacaaggcattaggccatgagttaattaagctagtgggaggaaaagataatatcagcagactgacacactgtgcaacccgactgcgatttgaattttacgacaaaaataaagtagatttaaaaaggattgaaaatacacctggagtaatcaacgtcgtagataaaggaggacaatttcaggttgtcatcggaaatgaggtccagactacgtttcgcgtgattgtagatgaaatgggagatcaggcagcttctaatggaaaagaggaaaagaaagaagacaagggaagcatagttaacagaattatcagtgtgatctctacaacctttactcctgtcattccggcattaatcggaggaggtatgatgaaagcagtcctttctattttagtactgctgaatctggttgatacaactggcactacttatggaatcattaattttatctcagatgctccattttatttcatgccggtccttttagcatatggagctgcaattaaatttaactgcagccctattctcgctatgactatggcttgtgccttgcttcatccaacctggagcggtttcgtggcagcaggggaagcaatcagtttctttggaattccggtcactctggtagattattcctattctgtgattcctattattttaggtgtatggattctgtcttatgtagaaaaatttgcagagaaatattctccatctataatcaaattttttataaaaccgttgattattatgtttgtctcaattccaattggtttattgattgttgggccatttggtaatctgttaaatgatatggtacaggcaggagcagattttattaatggaaaagcaagctggctgattccaatgctgatgggtgctttccaaccattccttgttctgacaggaacagcctgggctatgacaccaattgcaacagtgcagattacaaatgtaggatttgagacagtcaacggtcctggtatgctggcatcaaacattgcacagggtgctgctgcactggctgttgcagtaaaaacaaaaaatagacagttaaaacagttggcatcttcttccggttttacaggtgtgatgggtattacagaaccttgtctttatggagtgaatctgaaattaaaacgtccatttattgcttctatgatcggcggtggaatcggtggaatctatgcaggtctttccggactggttcgatactcttttgtctctccgggactggcagcaattccggcatttattggggaaaatccaatgaatgtggtacatgcattgattacaattgttatctcttttgcagcaggttttgcggcatcctggattcttggatttgatgatcctgaagaggagagtccggtgaaggataacatttcttctgaatcagaaaaattgcaggatgttactgtaaagagtgaaataaaaggtgagattgtctacgcgccaatcaaaggaagagtgattccattagaagaagttcctgatgaggtattttccaatggcattttaggaaaaggagctgcgatcgtaccggaggaaggatgtgtttatgcaccttttgatggaaaaattgcttctgtttttgatacaaaacatgctatttgtttagtaagtgatgatggaatggaactcttgatccatgttggaattgatactgtaaatctggaaggaaaaccatttactgcagttaaggatgctggagacaggatcaaaaagggagaaaaactgctggaatttaatatagaagagattaaaaaagcaggatatgagacagtgactcctgtattggttggaaacacagacaactataaagagattgttccaatcagagaaggagaaattaatccgacagaagaattcattcatgtaatagcataaagggtgtaagaaaaatgatttataatactaaaacgaattttcctgaaaattttttatggggagcttcaacctctgcctatcaggtagagggagctgtcctggaggatggaaaaagtccttctattattgatatgtatgaacatccaaaagatacagcggggtttcgaatagccagtgattattatcaccgctataaagaggatattcagtggtttgccaaaatggggcttaaggcatatcgtttctccattgcctggacccggattttaccggaaggtacagggaaaatcaatcagccgggagtggattattataaaaatatcattgccgaatgtcgaaaatataaaatagagcctgttgtaaccatgtatcattttgatctgccctattgtctggaagaacagggtggatggaataaacgggaaactgtagatgcttttgtagagtatgccagggttttgtttgaaatctacggcagagaagttacttactggcttacaattaatgaacaaaatacaatgattttgcatccgggagcaatcggcttgccaaaaggaggcactcttcctaccaaaaaggagctttaccagcaaaatcatcatatgatgctggcgcaggccagagttatgaagctgtttcataaaatggtgcggaatggaaaaattggaccggctttaaatcttactgctatgtatcctgcttcatgcagaccggaagatgcaatcgctgcccataactgggtgtcgattcggtgctggaacttcgctgatgtccctgtgtttggaacctatcatccactggcgttttcttatatgaaagatcggggaatcgctcctgagattttgccaggagatatggaaattctaaaagacgcagatccggattttattgctatgaattattattctaccgctaccattggagcaagcagaaatgatagttctgatgtggccgcgcgggcaggagaccagcagattatgctgggagaacagggggtatacagaccggaagaaaatccctatgtggataaaacaaaatatggatgggtaatcgatcctgtaggcttccgttacaccttaagaaaggtatatgagcgttatcatcttcctattctggtaacagaaaatggaatcggagcaccggatattctggaagatgggaaaatacatgatgattatcgaattgattttctgaaaaagcatttaattcagatgaaactggccattgcagacggagtagaaatgattggatattgtccgtgggcagcgattgatgtcgtcagtactcatcagggatataagaaaagatatggttttatctatgtggacagagaggaatttgacttaaaggagatgaaacggtatccgaaagatagttttttctggtatcagaaagtgattgccgaaaacgggaaaagcctgtagaataggaaaaaagacgtataaaaggaacgaagaacatgattgtgaaaaagatattaaataacaatttgatattggtatccgatgaaaagggaagagagcatatcgtcatgggcagagggcttcgctttaccaatactgtgggcaaggaattggtagagtcggacatagagaaagtatatgtattaaaagaagaaaatacaaaaaattacatgagtcttttggaagaagcaccgaaggagtacgtagaaacagttcaggaagcagttcgtcttgcaaatctgtggtcggaaaaagaattaaatgaacagctttttgttaccttgtttgatcatttgatttatgctctggaaagatataacaatcatattgtgcttcaaaacaggatgctttgggaaattaaacagttttatccaaaggaatatcaggtcagtgaaagagtattagcctttttaaataaggagctgtccattgaacttccggaggaggaagcagggaatattgcttttcatcttgtaaatgctcagtcgggacagaaagatatgggaaatacaattctgggaatcaaaatgcagaaaaacatttttaatattatccagatgacttttcagaagaaattagatgttaattctatgaattatacacgtctggtcattcatatccagtttttccttcaaagactatttgaagataaaatgctggatgaccagggcgtgatgttttacgaacatatcaaagaaaaactgccaaaagaattaagttgtgtaagacagatacaacgatatatcgaaagcaccattcaaaaaaccataacggaagaagaaatagggtatctggcagttcacatctcaagggtgatatcataaaagaaagcaggagtattcaaattggatactccttattttttacagaaataaatcattctttatagagataaaataattaagtcatttgttaatttaaacctatatatagtcaggttacgtgtaatgcatcagaccaataatattcaccattttcctcatcatctgtgaaatcccaaaatgaatcagttccaaagccaataacgcgtgtatcttgttgacatcaaaagcatgtatgaatgcctgtaataacataaatattatcacaaataataccattggcaggtaaaatccattttttaaaccgcatgtagtgttttttactagaaagacggattgcttttggcgagttaagatgaggataaatttctcattttaacttgtactaaatcttgacataggaccaaaataaaaacaagagttgtactagaattatttttacaataaatagaaatcattataaggcattgagcttctttaatttcataagaaactcaaaacgttttgcaacgctctacatactcaatgctacctctacgatatatttgtcataatcgtaaaattgcataacacactggccccaaggatattctttgattccatggagaaactccagtttcactccgatcaattcctcgtagttggactgcagagacgggtcattttcaaaagaaacatgaacctccagatccatttctaccgtttgtccattaccttctcataaaaattttttgatctttccatgtcagacacctaaatcaacgtactgccgtatatcatattttctcctttctgctttgtacctacattatagatcaaaatttggcaatctcgctgtaaaaatgggacatctcacgacggcattcctgtggagaaattttgcatacagatttaaaatcgtggataaagttaggcagatcataaaacccggataaattacaggcgttggtgatgctgtattgatgcggaccaggctggaaaaaatgcatataaaccggccgatcattctggtctcatcacatgaacataccagagttgcgtacccatggggatgacggtgtaatgatttgagatcatgtcattgccggggaaggtaacagtgcaacttgaaatccaatcccgcagtgccggatgaggaaggagatacatataatcttctcctttttccagaacacgatgaggttcacgataaaatttcaggtcatctttagtgatcataagctgccagtcctttcaaattttatataccagacatacgttttatagacttcgtcataacatatcaaatgatgttggggtcaaaatatattttaacccctggatacctgcggattgttccgcactttgtgttcccacaatcctaaaaacatgagaaatccgccctcatcgggctgcagcagcgcatttaggtattaatttgggcaaaaatatgttaaaatttatgtatctcggatagcggagggaactgcatatggatggttttattcggttggaagaagtgaggaaaatatatcagacgggacaggtcgttaccaaggccgtggatgggattaattttaccatcagtgagggagaatttgtcgttatcataggagccagcggcgccggaaagacgacgattctgaacattttgggagggatggacacagtcacctccggttctgtttttgtagatggaaatgatatcgcaaagtattcaaggagacagctgacccagtaccggagaaatgacatcggatttgtatttcagttttacaatctggtgcccaacctgacggcgctggaaaatgtggagctggcccttcagatcagcaaaaatccgctggatgcggagcagattctctcggatgtgggactctctgagcgcctgtctaatttccctgcccagctttccggaggagaacagcagcgggtttccattgccagggccctcgccaaaaatccaaagctcctgctctgcgatgagccaaccggggcgctggactataagacaggaaagtctattttgaaactcttgcaggatacatgccgggagagaaataagaccgtgatcgtcatcactcacaatcttgcgatcgccccgatcgcagaccgtgtaatcgagatcaagagcggaaaagtacatgacatgtggatcaataaggaacctaaatcggtagacacgatagaatggtaggtgggtcacatgaagaaagcgcttcataaagacaattttatgatggtccgaaaaacactgcccaggtttctgtccattttttttattgtagccctgggagtcgcatttttttcaggggtccgggttacagagcctgatatgaagttaaccgcagatgcccaatttgacgagagcaggctcatggatctaagggtccttggcaccatgggtatcacagataaagatgtaaaggcggtcagagaaatttccggggtttccgtggcggagccaagctgctctgtggatacgatctgtaaattgaatgacacagagatggtcttaaaagtcatggcggcgaccggccggctcaaccagatcaaagtcacagagggcaggatgcccgaaacgaatggcgagtgcctgatcgattcttatctgatggaacattcggatattaaagtcggcgatacgatcacagtgtcttcgggaactgatgaagatatcggggagacattaaaaaaatcagaactcagagtagtcggagtgggaagttcctcatattacctttccagggacaggggaacggcaaccataggaaatgggcagatcagcggttttgccgtggtgccgaaagaaaatttcaaattggatgtctacacggatttgtatatcactgtgaaaggagcggcagagaagaccgcatatacggacgattacgacaatatcgtagagaaaacagaaaaaaagatcaggggtatttccgacagccgctgtgaggccagacaaaaagaaataaaggatgaggccaaaaaggaagtaaagaaagcagaagacatatatataaaagaaaagaaaaaggcggataaagagcttgtcaaagcgaaaaagaaactggtagacgccaaaaatgatataaacaccggggagagggagatcacaacccaggagactgagatttcgcggggtaaaaaagaaataaaaaaaggatggcagagctataacagcgggaagaagcagcttgcaaaggccgggaaagagatcaaggccaatgaaaaaaagcttgccagggcagaaaaacagttctttgaagcgaaagaacagctgagagaacagatgcagcaggcaggtgccatggggcagattcctccggaaatgcagatgaaatttgagcaggcaaagaaagaactgtccagagaggaggctgtcctaaaggcttccaaaaaagaactggctaaagggaaaaaagaactgaaggcgaataaacaaaagctgaatcgttctgccgctctgctgagacagaacgaaaaagagctgaaaagcggtgaacagaaaattcgggatgccagagaagagctctcaaacgccagaaaaaaacttgaaaagggagagaaagaatataaatcttccaaaaagaaggcggaccgcaagtttgccaaggcaaagaaaaagatcggcgatgcccggaaagagattaatgatataaagatgcccaaatggtatgtgctggaccggaacaggatccagtcttacgtggaatacggaggggataccgaaagaatcggggcgatcggagaagtatttccggtgattttcttcctggtagccgcactggtgagtctgacgactatgaccaggatggtggaggaacagaggacccagatcggcattttaaaggctctgggatacacaggtttcgatgtggcaaagaagtatggattgtatgccctgcttgccacggcaggcggaagcatcgcgggtgtgcttgtgggagagacaattctccccaagatcattatagaggcatattctatgatgtatacggggatcggtccggtacaacatccgtttgagaccaggtttgcactgacggcatccacggcttctgtgtgcatcacgcttggagccaccatatttgcctgctataaggagctgagggaaaaaccggcgcagctgatgcgcccggaggcgccgaaggagggcaaacggatcttgctggagcagatcggaattctgtggaggcatttaaactttacgtggaaatccacgttaagaaacctgttccggtataaaaagcggttttttatgaccatattcgggatcggcggatgtatggcgctgctgctcgtcggttttggattgaaagattctatttttgccatatcaaaaaatcagtatcaaaatattatgacctatgatgcatcggttaccctggaagataatctgtctgtaaaaaaggagcaggaaattgcatcttggatacaaaaacagcatacaatacggaacagcaccaaaatccacaatgtctctgtggatgtggagtttgacggggaccgcaagtcggcttctctgtttgttccggaagatgcgaaagaactttcggcttatatccggtttaaggaccggatgtccggggagaaatatcggctttctgacagcggtgtgatccttacggaaaaagtatgcaccctcctgggcataaaagaaggagataccgtcacgatcaaggaaggagaaacaaagtcggttggagcaaaagtagagcatatcacagagaattatatgcgccacaatgtttatatgtccaaaaagttataccagaagctatatggagaaaagccggagtacaatcagattcttttaaaaaacaaggacagatctgataaaacagaaactaatctcggaaaaggcctgctgaaacaggacggagctgcatctgtttccttcacttcggattttgagaaagagatgaacgacatgctgaacaatctgaatattgttgtgtttgttttaattgtatctgccggactactggcttttgtagtattatataatctgaacaacattaatatcgcggagaggaaggcggaacttgcaacccttaaagtcctgggcttttttgacatggagaccgcggcctatgtctacagggaaaatatcctgatcaccatcataggcacagctgtgggagcgggcttgggcatcctcctccaccgatatgtgattttgactgcggaggtagatctgatcatgtttggaagacagatcctgccggccagttatctatacagtgttctgctcaccatagggtttgcggcgctgatcaatttcatgatgtttttccagcttcggaagatcaacatggtagaatctttaaagagcacagagtgacaccccaaaggtaggaagggagattgactatgaaagaattaacaatgaaggacctgatattttatcacatttttccgctgggagcttttgtggatgatgaggcagaacatggaatactggaagtgaagaaatggataccccatatcaaaggactcggagccaatgccatttatttttcaccggtttttgagtccagcagccatggatacgatacgaaagattataaagtgatcgatcaaaggcttggaaccaacgaggattttaaggaagtatgcggcaccctgcatgaggaagggataaaagttgttttagacggtgtattcaaccatgtgggcagagagttctgggcatttcaggacgttttggaaaagagacaggattctgaatacagagactggttctatatcaattttgacgggaacagcaactacggcgacggattctggtacgagggctgggaaggccattttgaactggtaaaattaaatctggataatccggcagtcagagaccaccttctggatgcagtgggtatgtggatggatgaattcgagatcgatggtatccgcctggatgtagcctatatgctgaaccggacgtttatgaagactctggtggattttgccagagacagaaatcccgagatggtctttataggagaaatgctgcacggggattacagcacgctggtcaatcaccatatgcttgattctgtcacgaattatgaatgttataagggattgtactccagttttaatacccacaacatgcatgagatcggttattctctgaaccggcagtttgggccggaaccatggacgctttaccaggggctccctctgtacagttttgtggataaccacgatgtgatgcggattgccacccagcttacggatgaaaagcatctgcctctgatctatgcactcatgtttgccatgccgggggtaccgtccgtctactacggaagtgagtggggaatcgaaggatttaaggaacctggcagtgacgattcacttcgtccgagagtaagacctgaggatcttaagcagggagaactctataaatacatcgcaaagctttcagaggtgaggaaagacagtcaggcactgaaagacggcggttacagagaaatacgcacggaacaggatatcatcgcttttgagagggaagccggagaagagagaattatctttgccctgaatgcaggaccggaggaatacacgctgcattttgacgccagagcgggaaaaggtacagatctcttgactggagaagagaaggattttgggggagggcttttgattcctccgtaccaggctgtaattattcaacctgagcattaggctttcttgactttttgtgcaaaaacatttaaaattagaagagtgttttatgcacaaaaaattgaataaggaggaggcctgtggtaagtataattattgccattatcgcaactctggtcattgtagcgccaatttccgtccttgttgccaatcaaagaagcaggaaggccatggaagtaaccattggaaatgcagagagcaaagccagagatattatagatgaagccataaaagcagcggatgcgaagaaacgcgaagcttcacttgagatcaaggaagaaactataaaagcgagacatgactttgaaaaggaaacaaaggaacgcaggggcgaactgcagaagtacgaaaagcgcgttctcaacaaggaagaaactgttgacaaaaaggctgagatgctggagcgcagagaacagtctctgactgccaaagaaaagaattttgaggcagacaaggcaaaagtgcaggagctcaagtccaaacacttacaggaattggagagaatttctgggctgacctctgatcaggcaaaagaacaactattatcagcagttaaggaagacgtaaagcacgagacagcgatgctcgtaaaagagatggaatccagagcaaaggaagatgcgagaaagagagctaaggaatatgtggtcacagccattcagaagtgcgcggtagaccatgtggctgagacgacgatctctcttgtacagcttccaaacgacgagatgaaaggacgcatcatcggccgggagggcagaaatatccgtgcccttgagaatatgacaggagtagaattgatcatcgacgatacaccggaagcagtcgtattgtcaagttttaatccggtcaggagagagattgcaaggattgctcttgaaaagctgatcgtggacggaaggattcatccggccaggatcgaagagatggtcgaaaaagccacaaaagaagtggagacgaagatgcgggaagacggggaggctgcaactctggaacttggagttcacggcatccatcctgaactggtccgcctgctgggcaagatgaaataccgtaccagctatggacagaacgcactgaagcactctatggaggtggcacagctttcagggctgctggcatctgagatcggagtcgatgtcaggatggcaaagcgcgctgggctgctccatgatattggaaaagctatcgaccacgaagtggaaggttcccacgtagaacttggagtgaacttgtgcaagaagtacaaggaacatccaatcgtaatcaatgcagtggagtcccatcatggggatgcagaaccagatacattaatcgcttgtcttgttcaggctgcagatgcaatttctgcagcgagaccgggagcgagaagcgagacactggaaagctatacgacaaggctgaaacagctggaagagatcgcagattccttccagggtgttgataaaacttttgcgattcaggcaggtcgggagatccgggtaatggtagttccggaacagatcagtgacgacgacatgattttgctggccagggatatttcaaaacaggtggaagataacctggattacccgggacagatcaaggtcaatattatccgtgagtcacgggttgtggactatgcgaaataatcaatgtaaagtgagacagcagatgaatttattcatctgctgtctttttctgctgtgagaaatcttttacacatatttgaaccgcaaaaaacatgcagataaccgcatttttgtacgaagaatgcgggttattttatataaaaacgcatataactgcaagaaatagcattgacaatgcaaaaatatgctggtattataaagacatagcaaataaaacaggcaaatagacgcatgaaatgcaaatgaagacgcaaaaaaatgcagaaagaaaggaaagcaaatatggaaaaatggatggatttaagcgggaaagttatgatcgtaacaggcggaagccaggggatcggtgaacatgtagttgagacattgagacaaaacggtgcggcagtagtagtagcggatttgagaaacaatgagagatttgaaaaggatgagaatatcttttttgttgagtgcaacgttgccgacaagaaaagtgtggatgcgatggttgagcaggttataaaaaaatatggaaaaattgatggccttcttaacaatgcaggagtcagccgtccgagactgctggttgatttttacggaaaacggccggaatatgaactttcagaagaagacttcgattttatggtcaatgtaaatcaaaaaggagtgttcctgtgctcacaggctgttgcacgttacatgataaaacagaaatccggagtgatcgtaaatatgtcatctgaggcagggatgcagggatctaaaggacagagctgctattcaggcaccaaaggagcagtcctttcttacacaatgtcatgggcgaaggagctgggcccttataatatccgtgttgtcggtgtggcgccgtcgattaacgagagaactcctatgaataacgacgcagcatttgaagcacttgcttatacaagaggacaggataagaacaatatttcatctgattatgaaaaagttattcctatgggaaggccggggaaattagatgaagttgccgatttgatctgctacctgatgtccgaccgcgcaagttacatatcaggaactactgtaaatatcagcggagctaagtctacacgttaaaaagcatttaaatagtaaaaagtataagaatgagaaccggaggtgtaagatatggaaacaaaagcaggggcactggacagaattcgtaaatttggcgggcatatgagcgggatggtcatgccgaatctgggtgcatttgtgggctggggactgctggcagcattgttcataccaacagggtggattcccaacgaaaaattaaatgagatggtaggtccgatattaaattatctgctgccgcttctgatcggctatacggcaggctataatatccatggacagcggggaggtgttatcggtgcatttactaccatgggagtgattgtgggttctgatatcactatgttcagcggagccatgatcatgggtccgttttcctcatggattctaaagaagtttgaccgtgcagtggagggaaaaatcaagcccggatttgaaatgctcatcaataatttcagccttggaatccttggatttgctttggctatcctcggttatttgatcatcgggccggtggtaaatgcaattatcgcatttttgacggcaggaataaacttcctgatcgcgaagaaactgattccgcttttggctgtattcatgtgtcctgcccaggtgttgtttttgaacaatgcagtaaatcatggaatcatctcaccgattgcattcgctcaggcccaggaggccggtaaatccctgatgttcctgctcgattctaactgtggtccgctgctgggcaccttatgctccattgctgtttttggaaagggaaaagcaaaagagacagctcccatggcgatgtttattgcgggaatcgccggtatcggggaagtgtattttccttttgtcctggcaaatccgatcatgatttttgccacgatgggagggcttgcaacctctcttctgctcctggtcgtgttgggcggcggtctggtcggcatgccgtctccgggcagtttgataaatatagcccttatgacaccaaaggatgctgcggtggcaaatgttctggcaatcggagcgggattcgcggtggcgctgctgatcggttcatttattctgaagaccataggctctccggaggaagaggcagatcttgccgtggccggtgtcgatatgggaacaaaggcagaaaagccggaagcggcctttaagaaacataagccttctttaggaggcgccattcgttacatcattgtggcctgtgattcgggaatggggtccagtgccatgggagcatcggttttaaagaaccgtctccagaaagaaggatacaaagatattaaagtaaagaattcatcagccagccggatcgatcctgatgcagacatgattatcacgctggaagggctgattgagagggccaaactcagtgtagataatacaggcaaggaatttctggcgatcaacaacttcctgaaagaagctgattacgaccgggctctggaagtgatcgaagacagaaacggcaaagaaaaagtaaaacctattttatcagaagaaaatattgcgttaaatgtaaaggtaaaagataaagaagaggcaatccggtatgccggaaaaattttaatggaaaacgcgtatacgactccgaagtatattgaacatatgctggagaggcagaggagattctctgtctatatcggaaaccatttggcgatccctcatgggatagaatcgtcggattcggaaatatatacatcgggcctgtctgtagtacaggttccggaaggcgttgattttggtgatggaaatattgcatatgtagtcataggcatcgccggaaaagacggcactcatctgaatatgctcagcaacatagcattgatctgtgctgaggaagaaaatattgaaaagatgaggcgcgctgaaaacaaacaagagataatggaaatattgaagaatatttaatggccgcttttgctttccctttttcggcggattcgttataataatattaatttaatcaacagaatgtatgtgtaggagaaggtaaagcgatgaagatgttaaaagcagagaggcaggataagatcctggagatactgtccctcgaaaataaaattattgccagcgaattaagtgtgaggcttgaagtttctgaggatacgatccgcagagatattaaagaattagaccagagaggccttctgaagaaggtgcacagcggagcggtaaaaaacggacctttgaaggaagattttgatgcaaggattgatctgaatctggaagaaaagattcgtctggccaaaaagggcgcagaattgattaaacccggatcagtgattttgattgatgacggaacaaccaattatcaggtgatcaggcacctggataaacacatgcgctgtacggttattacgaacagtatcccgatcatccttcttttaagggattatccaaacatcgatgtgatcacactgggcgggaatctgtataagtcttccatggccacttatggatatgaagtcatcaaacagctggaactgcttcatccggatttgtattttatgggaatttactgtatgagcagtgaagtgggcatcagccattcatccatagaagaatgccagctgaaacagaagatgctttctgtctcttatcagactgcagcgcttgtgacgaaggaaaagatcggatctgtgtcaaattatgtcatatgcaagacaggtgatattacatatttgattacagattctgatcagtaaatatagagctgtctttcagacataacactgattaggaggaaaaatgaagaatgtattgattgtaggagcaggacggttaggaaaagggtttgtaggcgaaacttttgacaatgcgggatggaatattacattcctggataaggacccgagagtttcagaagaattacaaaaacacggatgctattatgtgaaggtacaccgggtggatgaaatacaaaaccgtactgtcaaaaattttaaagcatatacttgtgatgaagaatactcatgcatggaagctttcttggagacggatgtgatcgtacttcccctttacccggaagattttgaagaggcggcaggttatctggcgaagtgctttgaagaattttacagggttcatccggaccgcagactgactatgatctgtattacaaataaaaactatctgatcccgggaattacggaggcattcagaaaagacttgtccgaagaagcaaaggagtggtttgatcagaatgtagtgatccgcgactctattatccgcagaagtacagatgcgaagagcaattacgatgttcacattgataccgttgcagttaattcgcttttgatccagcagccggtcaataacgatttcagtgatgtggaatggatggaacttacggacaagattgagatgctcaaagacattaaagtcaccgcagtcaacggtccccatgcaacgctggcctatatgggatatttaaaggggtacagtacgattccggaatctgaggctgatcctgagatcgcggaagttgtggaaggagtggtagaggagatcacggcagccgttatgaaggaatatccgattacaccggaagagctgcacaatctcgtttattttgcaccggccaagggtgtgcttccggattctatctacagggtaggatacgatccgattcgtaaattgtcaaaaggagaccgtctgacaggagccgccgagctgtgtctgaaacacggcgtcagtttcgattcgatcgccaaagctatggcggccggattccaatatgcggagcccagggacgcaaacgcacagaaacttcagcaggaaattaaaaataacggaattgaacaggcggtatctgaatatactggtctggacgcagacagcccgattgcaaaacgtgtaatcgaatattatcatcagtctgtaagctaaaaggtggggaatcatatggatggatataaaaaaatcagacagaatcttgtacaccagggaaaagtagtgggcttttatgaagatatcattacactgcccaatggcaatactgtcacctgggacctggtaaagcatccgggagcagcagcgattattccggtcacagaggaaggaaatatcctgctggtccgtcaatatagaaatgctctggatgcaatgacttatgagataccggctggaggtattgaacagggggagagcgggtacgactgtgtaaaaagggagatcgaggaagagacaggatgcagggcagaaaagattgaacctctgatcacgattgtaactgccattggcttctgcgacgaaaaaatcccgatctttgtcgggaccggacttcataagacagagcagaatctggacgaagacgagtttatcgatgtatatgaatttacgccggagaaagtgaaggatatgatcctaaaaggagagatcgtggatgccaagacgatttctggaatcatgacatatttaaatacgctgtaaggatgagatacccggtgtcataaagaaaaaagagagcacatataattttatgtggctctttttttatatctgcggagcaaatgatatctgggagggaatttagatggagcggaagaaatttttcatcggcgtgttcgtgctgaccggtcttgtgctgggaagcctttttacaaatgcagtgtataaagattatctggagtatgggggacagatggattcccttgtgctcagcgggaaaggattatacatatcaggcagcagccttctgccctatattttatttaagaggggaaaacagtacggaattctatttctgatcggttttattttgaagccggttgtgcttttatacggcggacttttcagcctttctttttttctgggctctatcctgtctctccaggtgatgaatttaggaattgcaggcctgctgattgtgatactgagcctgtttccgcactatatctgttacggcgggtctatgtatcttctgtaccagcggaatgtaagagatgaaaaaaaagaagaaataacctttgatacaggtcattccttcttaaaaaagttttccattcatctggaactgatactgctggtgctgggctgctttttagagagctatgtcaatccgggaattttaaacatgttcagccatcttataaagtaattcctcggtcttttcccatccaaggcaggggtctgtgatggattggccgtacacgccgtttccgatcggctggctgccgtcttcaatgtagctttcgatcatgatgcctttaacgagagaattgatctcggggaggaagcttcggctgtggagaacttcctggacaatccttggctgctgatcccactgctttccggagttagagtggttggcatccacgatgacagccgggttcgcaaggccgaatttttcatacatataagcaactcttgccagatcttcatagtggtaattcggcacattgttgccgtgcttgttgacagagccgcggaggatcgcatgggtcagaggatttccgtctgtatttacttcatagccgttggcaatgaaattgtgggaactctgtccggccacgatagaattcatcattacggtgagatcgcctccggttgggtttttcatccctgcgggaatgtcgaacccgctgacagttagacgatgctgctgattttctacggaacgggcacctacggctacgtaggataaaatatcttccatataaggccagtttccgggataaagcatctcatcagccgcaggcatgtggaatgcttccagagcgtcgatgtggagttttctcacggaacggagacctgctgccatatccggagctttctctggatccggctggtgaaccattcccttgtatccggcgccgtttgttctcggtttatttgtatagatcctggggatcatcagaagtttgtcggaaacttttttctgaacgccggccagtcgtcccagatagtccatcaccgctgtctcattgtcggcagagcagggaccgatgatcacgataaacttttcggactcccctgtaaagacctttttgatctcttcatctctcgccatttttatctgttttgcctcttcgctcaaaggaaattcctgctgaagttcctcagaagacggcattttattgattctatgcatacccataatcttacctctcctttatatctcaatctgtatgtagacggcccataaagccgattgttataagtttaccaaatgtccacagtgctgtaaagaaggaaagacaaaacgatgtgtacccgaaaaaattctgaagatgactttacaaacgggaaaaatttgtctataataaacgtagtataaaattgcatatcgaagtagagaataataattctccaacttcagggcagagtgaggcgtttaaaagcgtcaattctcgactggcggtgattcttctttatttagaagccaagtccgcgaaccgaaaggccgattgagtgtgaatctcaaaccaacagtatagtctggatgaaagaagtaaccatggacggtatttttgtatcgttcagcacagccctgtctttggtgacatgggcattttttattttgcgggattggatcagacagccccctcagaataaaagaattgttaaatggaggagaaagaaaatgatgaatgaaacagcagcagtgagtaaagtaaatgtaagaaagatcacagtgaccgccatgcttggagcgctggccacaatcctgatgttttttgaattcagcgtaccgtttatcatgccgggattcattaagatggacttttccgaacttcccgctctgatcgccgcgttttccatggggccggtatccggcatcgcagtgtgctttattaaaaatatcgtaaatcttctgcacactacgtccggcggagtaggcgagatttccaacttcatcctgggagtctgctttgtacttccggcaggtttgatctataagagaaataaatcacagaagggagcattgatcggtgccctgacaggagccgttataatggcagtcgtgagtgtgttttccaactactttatcgtctatccggtctatgaaaacttcatgccgatggaagcgatcatcggagcttaccaggcgatcaaccacaatgtcaggaacttatgggatgcattaatttggtttaacatgccatttaccttcgtaaaaggaatgttcagcgttgtaatcacatttttggtatataagaggatatccccgatcttgaaaggaaaacattaagatttaagacaactatcacagaatataataaaacgtcaatccgaaattaaggattgacgttttttaagtatgacgggcatgtccgtgttctgtggtgcaagtccacataggcgtagctaccgacgaacttgtaagcgactcccaaggtttgcatcgtgaggtgtgggcgagaagaagggatagcgaaatcgtagccctacggacagaaacccgatattaaggcgtacatggtgggtaagttgacttaaagcaacgaagccctaaaggtagccgtaacccatgtgcgtaaatcgggagggtagacgaggaaagaacacggacttatcccgtgaggtctcacaggcggtttcatcagccgtagtaacaacgaactgtgagaagtcagcagaagccatagtaggagaaatctgaagggctgaacaatgtaaccgtgcagacgaatgtatgtacctgtgagtattcgacaagcggatgtaggcgaaacgtatatgagatgtaaacgcataaacataggacaaatcacagggagcggaaaggagcgaagcacacaaagtatgtcggaattgttggaaaagatactggagaaaaagaacatgaacgaagcatataagaaagtctgtgccaataagggtgcaggcggcgttgacggcatggaactggaagaacttgatggatttatccgtaagaactggaacagtatcagggagcaaatcagaggaaggagttacaaacctcaacccgtgaggcgtgtagaaatcccgaagcctaacggaagcaaaagaaaacttggaataccgacagtcatggacagggtaatccagcagggtaatccagcagggtatagcacagataatcagccctatgtgcgagccgctgttttcagaccacagttacggattccgtccaaacaggagctgtgaaatggctatcaaagatatgctcatgttcctcaatgagggatatgagtggatagtggacatagacctagagaaattcttcgataacgtaccgcaggataagttgatgagccttgtccacaacatcataaatgacggagatacggaatcgctgatacggaaatatctgaaagcaggagtcatggtgcagggcaggtatgagaaaacagaacagggaacgccgcagggtggcaatctgtcgccgctattgtctaatatcatgctgaatgaactggataaagagttggaaagacgtggattgggcttcgtgaggtacgctgacgactgtgtaatagcagtcagaagcgaagcaagtgccaaacgtgttatgtattcgataacggactggatagagaggaagcttggtctgaaagtaaatgcagataaaacacacataacaagaccaatgaacctcaaatatctcggctttggattctggaaagattccaagacgaaagaatggaagtgcagaccacacaaggattctgtgcagaaatttaagaggacgttaaagaagctgacagaaagaagaaaatcaatggcgtttgcggaaagggtaaaacagctcaacagggtaatccgaggttggataaactactttgcaataggtaggatgaaaacagcaatgaccgacatagacgcacatttgcgtacaagactgcgagtaataatctggaaacaatggaaagtaccgaagaaacggcagtggggattgcagaagctgggtataggaaaagaccttgcaagacagacatcatacatgggagaccactatcaatggatagtaacgaaaacctgtgtagtcagggcaatctcaaaagaaaagctgaaacaggcagggcttgtgagttgctacgattattacatggaacgtcatgctttgaagttatgttgaaccgccgtatgccgaacggcatgtacggtggtgtgagggggctgtcgctttaacgaatgaaaattcgtgaagcggcagcttcatttttgctgcttttggcatgaaatccaatcggaaccacagatttatttaatcatttgataataatggcgcactttaataagccattttcgatggcttaaaaatttattttgaaatgtctaaattcaggcgctttttaatgggaataaatacgttccggttctgccattttgaatcttattatgaagcttatttatgtttcttgccatggcaagcagtgtgctttctgcaagtacgttggatgctcctttacttaaatatctgcggaactgcatatcctgtttcaaatctccaaaggatccttctgcctgtatgctccggtttgtcctgaaaaggactccttgctccgaaacgatccgctccaggttttctttcctgtgttttaaaaatgttttggcaacctgaagcttctttgttctttcttccataggtgttttgcagttatttccttttatgcattcacttttgtatgggcagccgctacagtcttcgcatttataaattgttttctcgcttatataccctgttttgctttttgagtggcggatatggtccgctcctaacttttttccgttcctgcaggtataaatatctgcttcggcatcatactccatgttttcaattcttccgatatcatttttatatttacgggttttggaaatctcatagtttgcaggtttgatgtacgatatctgtccatttgtttcgagaaacagatagttttcctcactttcgtatccggcatccgctgttatgtttttgtatttgaattttaaatgctgctcagcatctttcaaaaatggtatcagggtcgtggtatctgtgggctgtggtccgatggcaagccatgtgatatattcagagtccacgccatgctgaagattgtaagcgggttttagctgtccgttccccatagcgtcttccttcatccgcataaatgtggcgtcatggtcagtcttggaataactgttgcgctctccgcatatatgaacctgttggttgtacttttttaaccgtcccagataatcctcgagagtttcaatgcttttttgaagcggtgttttcctcttaccggttccatgcacaaacactacctgttccgattcctttaatgcatacagttttttgcgcagccttttcacatgctttatctttatcgtatttccgtaggcaattctgatatcatagagctgctcacattcagccacaaaaccggcaagtttttgtaaaagcttactctgattctttgtgactgcttttttccagacaaaagtatatttattcgcaccggcttcgatttttgtaccgtcaatgaatatggtttctcctgaaatttcaccaaggtcaaaaagcgcatttgacatttctgcaagaatacgcttcgaacatggtgcaaaatggatgcttctaaaccgggcaaacgttgcatgatccggcacaggggcaccttccagaagaaacatgaagttgatatcccttttacaattgagttccatggaacgggaggaataatctccattcatgtaagagtagagtacaatcttcaggagagttcttggcgatacagaatttattctttcataagtagaatacaggtcagtcaaatccattgcctccacaaactgacttagtaaccgcacagaatcattatccggaatgattgtttcaatatttagcggaagtttcagttgatatccgctctgattttggctataatctttttgtaatttattaagtgttagcatactaatattttacaccaactgccggattctttcgaggtctggcagttattttttgcatagaaaaggagctgcgcactaatcacttagtgcgacagccccactcgattttcataggaaagttctacgaccttccctatgaaataaaaacgctccgcgggttgtgcacagatgcgtaaggaaattatttgcctgcggcaaattgcatcaggcacgcaaagttgtcaagggggctgtcggttaatagacagtcatgaatagtgaaggcagcgactcggtgatgtcgctgccttccctaactttatccctataaaaagagaaaaagatggctaaccataaccatctcctctccgttacatgttataatgtaactatgcataaacaagattattataaccgatttttcgaattaggacaactaaaaatgaactttaacttttatgaattgagtttacctgatgacgatccggtctttacccttaaaaatgtaatggaggaaatggattttacagcgttattggcgcagtattctggtaaggggaaacacgggtataacccaatcatgaaatatgcagttcttacatacgcaaatatgcggggaattcgtgagattgaccgtattgttgacctgtgtaaaagagaccttggattcatctggctcacgcagggcgaacagcccaaacgggatgccttctatgatttcataaacaaaaaactgacacccgaaatcttagatgacctgaattatcaattgctgcgacgattaaaaaaagaaggtctgatcacattagaatcgctttttatagatggaacaaagatagaagccaatgcaaaccgttatacatttgtatggcgtggaacactcaattaccatctggcagggcttcttgataccatcgattccctttatgcaaagtataacgagctcttagaagaaaacggatatgatgcaaaatacggttttggaaatgcacagatgtttattattgagggtatggataaagtgcgggaagtgattgaaaagaaccgcaagcgaaaacttacaaaacacaaaaaattaccaaacaataaaattatcgaaattgacaactgttctccattggatctactaaagctccagaaaaatttagcaacgatagcagatggtgaaggcattgggtttgtttacggaaaaggtaagaaaaaatctgaaatccagcagctttacgaagaactcgaaggatgtggcaaaaaactcatggaatacgcagaaagttttgaaatcatggggaaagaccgtaacagttattcgaaaacagatttagaggcaactttcatgagaatgaaagatgatcacatgatgaatggccagctcaaaccggcttataatgttcagattgctgtagagaactactttatcattcatggttatgtaagtaatgacagaaccgattacaacaccctgatcccagtcattcaaaaacacatcaatactttcggtgaaatattaaaggaaactactgcagacagtggttattgtagtgaaaagaatttactgttcctaaaagaacacaacatagaaagttatatcaaactgcaggatcatgaacagagaaagacccgtgcctataaagaaaatataggaaaatactacaacatgacaacccagatatttgaggatgaacgttattatgtttgtcatgatggcagggaactgagacatatccgcacagaagaaaaagaaatggaaggatatacacaaacattggaagtgtatggatgtgctgattgcagtggctgtgagcataaagcgaaatgcctgtataaatataacccagaaaaagatgccgacaaaaataaagttatgaagatcaatgagcgctgggaagaattgaaagaaaaatctcatgcgaatatccaaagcgagaaaggaatcctaaatcgtcagatccgctcaatccaaaccgaaggacattttggggatatcaaagaaaatgatgatttccggcgttttaatcaccgttcaacagataaagtatacaaagagtttatgctgtatgcgataggtagaaatatcaataaatatcatcggttcttatgcaataaactccagaggtttgaaggcaaacaggaagaaaacgcagcataaggaaaacgtggcttatttggaagagccccctttgttttgtgcgctcaaaaataattactgatcttagaaatagggataccctgcggaatatgacgatgctgaaaggcacgtatttccgcagggtatccctatttctcttttaaatcggaaaaatcggcattagccgattcctccttggggcgttgaagtgggcttgcccactttgttctgaatgtttaatttaatttttgttttgcattatctaaaaatgaatcggcggctacgatatagcgctcgtgtgtgccgataccgattcggcctttattgtccataatttccacctgaaactctaatttcttgcggttgatctctgtcagatgacactggcaggtcactttgcagcctacgggagtggcagatacatgggaaatgtttaaattggtgccgactgtggtcatgccctcatccagctttccctctaataattttacggcagccctttctaccaggagtgtcatggcaggtgtggcatacacaggaaggcttccgctcccccagcgggcggcagtcaattcgtcagtaacttcttctgacagggtgatcttgtctccaatttcaatcttcataagttgtcctctcttgatttattccatatcattttaggataggtaacatttcatacacttagtatagcaaaataagataaaaatgccatagttttttaagaatttattgtaatctatatatgtctgaagatgattctcacagcgtaaggctgtaaaagtcctcaaaaggctatggtgcaaagccggtaaatacgttaaaatagtttttgacggatataatattaaaattaaggtgaggaggaatcttattgaaattatacatgatgaggcatggagaaacttcatggaataaaatacgcaggattcagggacagtcggacattgatctgaatgaggccggcagagaggcggccaggctcacgagtaaggctctgaaagatttcagattcgacgcagcctatacgagtccgctcagcagggccagggaaacgggggagatcgtacttgcaggaagagatattccgctgatcgaagacgaacgcctgaaagaggccaatttcggaccgtatgaaggggctgacctgaatgaattatacgaaaaaaaagaacctattctggacttttttgaccgtccgcacaagatgacactgatcgagggcgcggaaaccccggctcaggtcgtagagcggtcgaaaatatttctggaggaatttattcttccgatggaaaaggaagcagaaagtgtgatcttatttacgcacggagcgtttattcacggaatgctgacaaacatgtataaaagagatgtgagagacttttggaaggggccgaagctgaagaattgttccataagtacggcagaattaaaagacggccgtttctgtgttctcagtgaggcagaggtcctttattgaaattcagaaagagaaagaagctaaaggagacatacgatgacgaaatatgagtttttaaaggaactccgggaagcgctggagggacaggtgccgatgagtgaaattgatgattccatttcctattacagagattatttcagccgccaggaggcagatggaaggagtgagcaggagatcttggaagaactaggcagcccaagacttatcgcaaaatccatcatcgagacaaagggcggggagcagatctattatgaagatacctatgaagaacaggtgaatgaagaggaaggttctccgaaagtttttgtgtttgattcttttctgacgaagattgggtgtctggcagcggtgatcattgtcatcatactgattggaagcgtgttcgccgtagcgctccgctttatcggaccgatcattatgatccttcttcttatctacctgatcaaaaatgtttttggaaagaggtaagggcagaaaatggatatcattcaggaagtaaaccaggccagggagaggatcgtaaagtacaggcaggatcttcaccgatgtccggagacggcctttgaagaatataagactacagcctatatcaagcggcagctggatgccatggggatatcctatacaccgttgcatcccacaggtattgtggcggagatcgggaagggcaggggagcggctgccctaagggccgatattgatgcattaaaagtaaaagaggagacagggtgttcttttgcgtcagaacatcagggatatatgcatgcctgcggacatgacgggcatgcagccattcttttgggcgcagccggtattctgaaaaagcatgaaaaggaattatcaaaaaaagtatttcttgtttttcagccggcggaggagactgcccagggggcaaaactggtcctggagtcagggctattagaaggtgtaaaagaaattttcggcctccatattttttccgggatcgaagccgggaagatttctctggaggcagggccgagaatggctgctacggactggttttctatagacatcagagggaaatccggtcatgccggaaaacctcatctttgtacggacgcatcggtgatcgctgccgccacggtcatgaaccttcagacgatcgtgagcagaaataccgatcctctggactcagctgtagttactgtgggaaagatgacctcaggtacagccagaaatgtcatatccggctctgccggaatcgagggaacggtccggacattttcggaggagactgaaaaaatggtgaaggaacgggtcatcgaaatcgccgtgggaacagccggtcagctgggaggagaagcggccgtagattatccgccgtccagtcatccgcctctgatcaacggggaatcgacggtggagagagccatgcggggagcaggaaagattttttccgagaaggactttgtgcatgtgcctccgatgatgctaggagaagattattccaactatttaaagacgattccgggagcctttgcatttgtgggaggaggtaaagatcagtttcccaatcaccacggcagatttgacatggatgaaaaggcactggtaagcggagtgaaactgatgcttgcttatgtcatggaagagtaggcagttcgcagggatgagcagtacaaaaaacggcagaatgtacagtatttcgtgctagaccgcaattcacaagtatgctataatcatagccaaagaaaaaataggcctcatttatggccttacagattataaaccagggaaaaggcgggtaattatgaatttagtttatcgtagtacaagaaacagggaagagacggcatctgcttctgaagcgatccttaagggactgacggatgacggaggactttttgtgccggattctattccgaagctccaggtttccgtagaagacctgacagagatgacctatcaggaaattgcgtatgcggttatgaaggagtttctcacagattttacagaggaagagttaaagacctgtattgccaatgcttatgatgacaagtttgacacagaggagatcgctccgatagtgaaagcaggggatgtatattatcttgagctgttccacggctccaccatcgcattcaaggatatggctctctccatcctccctcatcttttagttacttccgcaaaaaagaatcatgtgaaaaatgagatcgtgatcctgacagccacttccggagacaccggcaaagctgctctggccggttttgcagacgtgccgggaacgaagatcattgtcttttatccgaaatccggggtcagcccgatccaggaaaagcagatgctgacccagaagggtgaaaatacttacgttatcggcatcaaaggtaactttgacgatgcccagaccggcgtgaaaaagatgttctccaacagggaactggcagcagtgatggacgggaacgggtatcagttttcatctgcaaactcaattaacatcggacgtctggttcctcagatcgtatattacgtaaaagcctatgcggatctggtgaaaaaaggtgcagtaaaagcaggagatccgatgaacgtcgtagtccctacgggtaactttggaaatatcctggcagcgttttatgcaaaacagatgggaattccgatcggaaagtttgtctgtgcgtccaatgaaaataaagttttgtttgatttcttccggactggagaatatgacagaaagcgtgagtttgttgtgacatcatctccttccatggacattttgatttccagcaatctggagcgtttgatttacagaattgctggaaatgatgccgaacagtgtgcgaaatttatgaatgctctgacagaagacggcgcatatgagatcacacaggagatgagagaccagctctcagagttcttcggggcttatgccacagaagaagagactatggagaagatcagacagatctatgaggcagaacattatgtactggatacccatacggcagtagcatccgtggcatatgacaaatatatcaaagacagtggtgacaagacaccgacagtcatagcgtccaccgccagcccgtataagtttaccagaagcgtaatgaatgccatcgatccaaaatatgatgaaaagtctgattttgaattagtggatgagttacatagaatttccggcgtgactgtccccggcgccatcgaagagatcaggacggctccgatcctccacgatacagtctgtgagacggcagctatggaagaagaaatgaaaaaaatcttgaatatttaagataccaattattaaaaacggcagagttgaattctctgccgtttttttgtcacaaaaaagtatttttgatgtctaatactgcaggaggtaaaatttatggataagataacaaaccaacaacttgaactgctcatcggcaaagccgtagacggagacaaaaaatccctggaaacagtgatcatgagcgtacaggacctgatcttcaatctttccctcaggatgctcgggacttttgcggatgcagaggatgcgtcacaggacatcatagtgaaagtcatcacccacttgtcatcgtttagaaaagagagtgctttttctacgtgggtctacaggattgcggtaaaccatttgaaggattataaaaagcacatgtttgccaatagtcctctgagtctggatttttacagggatgatattgagaatgcccaaatccgggacatccctgatcttacacagaatgtagaggtttctattttagaagaagaactgaaaatgtcatgtaccaatgtgctgctgcagtgtctggacagcgagagcagatgtatttttattctgggaacaatgtttaaactggacagccgtatcgcaggtgatatcctgggaatgacaccggaggcataccgaaagaggctttccagaatacgcggcaaagttgcagatttccttgactgctactgcggtgaatttggccgggggacatgcagatgcagagacaggctcaactatgccatcgagaatcaccgcctggacccgggcaagctggattatacggcggcagataaaatttcagaacagacattgtttcatgtgaaggatgcaatggaagatattgatgatttatcaatgaaattttctttttgtaaatcctatgggtcaccggagaaaatgaaacagtttatcagggagtttctggattctgctccgttttctgtcgtgaaagaatcgtaaggagggattatacatgaatatggaactgattttaaattatttatcggaactcagtcgaaataataaccgggagtggtatcatgcgcacaaggaagagtatcagcaggccaatgcaactggtgagggacaccaggttcagccgtgataagtctccgtataatccctgtttccgcgctcacatttcatcaaaaggcaaactgccggttcccgttggatattatatcatgatccggccgggtgatcagtcttttttaggcggaggtttatttgcggatatgtttaaagacgctacaaggatggtgcgggactatctttcaaaacatcctgcggagtgggaacaaatcatcgggtctgaagagtttaagagctattttgctgtaaagggcacggcactgaaaaatgtgcctgcaggctacgatgaggatcatctacaggctaaatatctgaagaataaaagctggtatctggaatatttcataaaagacgaggaactcctggatggggaacaatttctggacagagctgcagacatttttcataaaatgaaaccgtttaatgattatctgaacagagcattggaaagctttaagatgcctcagagataaaaatgccataccctgagggcggacacgcatcgcgtgttaaggtatacccacagggcatcccgtattttataccctgagggtggacacgcatcgcgtgttaaggtatacccacagggcatcccgtattttataccctgagggtggacacgcatcgcgtgttaaggtatacccacagggcatcccgtattttataccctacgggtggacacgcatcgcgtgttaaggtatacccacagggcatcccgtattttataccctacgggtggacacgcttcgcgtgttaaggtataatttaagaaaaagtatgtgaggagacggtgattatgccaaaggatttatttgataagatcgagcagaccataacgactactgggaaggcagcggcgaaaaaggcaagggaagtagcagatacggcaaagattaaaaatgatatccgcgttgcgaagcgtgaattaaatgatttgtatgagcaggttggacggcagtattttgagtctcatatggattatccggaagcggaatatattgatctgtttaatctgatcgaaaagatccggggagatatcaaagtcatggaagcggaccttgagatggtcagagaagaagaatcgtaagattgagattagtaaaatataaaagccggcaggaaattttatcctgccggctttttagtgttgtgtgatcagagatttgtttttctttccatgagatatcttgtcaggaagaaggagacgataatctctatgatgctgccgatgatcatcataggcagcagatagtagcagaatttctcaagtccggtaaaattcataaagttcgggaagatggacgagaagatgttggtcacaagtgaaagtgccgcagttgcaaggaaataagttcctatggatgccgccaggcggtggttcggtaaaagacctccgatggtaatacagaggtatacgaacagcggtgatgatatggcactcaatatcaatgaagacaaagtctcagtgataaataaaaatctgattcctgggtcaatcttgttaaattcctggaatgaaagggacagcacatgacagaaatcggtccagtatggcgtacctgccaggaaaataaaaatagagaacatgaatgcgacggaggagataacaaaccagaagatactgatcagaagtttgttcaggatctgaaggttgatggaaacaggaagcgtaaagcttaagtatccttcatcggtataaaagttcttataaaaccggtaaaaagagataataaagcacatgaggtacagagcgatcacggccactacatagatggtcacaataaaaatgctgagagtcatgcgcagcggatcattgccgaatccgatcatcatcataaacagtttgaataacagtgtgatcccgccgaatgttgcgagcagaggcacaaaataccgggcggtggctttcaattcatatttcagtagttttcctagcatttgaatacctccctgaataactggtccacagatttttgtttctcctcccggatctggtcgacggttgcagacagagtgatctttccgttctgtaaaaacaggacgtcgtccaggacggtttcgatgtcactgatcagatgggtggaaatgatcaggctggcatccggattgtagtttgaaataatcgtttttaaaatataatcacgggcagcgggatctacaccggcgatcggctcatccagaagatataattttgcattccggctcatgactaagatgagctgtactttttcttttgttcccttagacagtgttttcaggcgcttattctcatcaattccaagatccttcagcatatagagcgccttttctttgttaaagtctttataaaaatcatcaaagtaagtaaatacttcatggattttcatccactccggcagatacatccggtccggaagataggaaatgtgctcccgggaatggatgccgaggggctggctgtcaaacaggatatctccctctgttgccgtcagcaggccgttgatcagtttgatcagtgtgctcttgccgcttccattagggcctaaaagaccgatgatacgtccggagggaatttttaagttgagtctgtctaaggctaaaaaacctgagtaaaccttagaaagattattacattcaagaatatagttcatatagatacctctcattgctatcttattagtttgataatgtcttcttttttcagaccaaatcgttccatcttcttcaggaactctgcaatttccttttcggcaattgaagcctgcagtgactgaatcagctgctcatcttcggtgacaaatcgtccgctggtcctctgggaatagagcaggccgctgcgctccagttcggacagtgctttctgcattgtattcggattcacagaagcacaggcggccagatcccggacggaaggcagctttcctccgagaggatagacaccggaaaggatatcgccttgaatatgttccatcagctgaagataaatcggccggtcatcggataattcccatgccataataaacctcgctttcttgtattaagtatctagtacaatggtataatagactggaaaaaaagtcaattaatttttaaaaataaattgactgtgactggaaataattgtataatgagatcaataaatggaaataaaaggaggatttacattatgtttcaaattgtagatatgacagatatgggcaatggccgggattccaatcaggactcttatctcctcaaagaagaagagatctgcggacagcagatattgatggcggttatgtgcgacggcatgggaggactcagcaggggagagatcgcaagcggatacattgtaggttcgctggaccggtggtttgcccacacactcccggtcctcctcaaacaaaagatgaagatcatgaggattcaaaaggaactggtggctgccatcaagaagatcaaccaccggctgatccttttgagccaagaatacggggacacgatggggagcaccctgacgcttctttttgcggcagaccgccggttttttgtactgaacatcggtgactccagagcctattggtttgaccgggaccagaagtatgtcaccagggatcataccctggtccaggaagaagtcagccgcggactgctgaccatagaggaagcgaagaccgatgccagaaaacatattctgatgcagtgcattggtgttacaaaggagatcaccattgactgttacaatgggaaacttaaaccggggatggaatttctgctctgcacagacgggttctacggtatgctcagggaggaggagatttacgaagtggaagcttccaaagacgagatgagacgatgggtgagaaaatgttttgataaagtaaaagaaagaggggaattggacaacttatcatgcattgtcgtaaaagtttcctgacatggacagagactgtacaggaaactgtatacttttaaagcggttaggcaggggaggacagggagagatctatttagcctgggatgaagagaaatcaagctacacagcggttaaaaggtttgaaagccagctcttggaaggaatcagggaagcgcggatactggagtcattatgtcatccggggataccagagtatcttggacggagatcggaagacggacacttagatctttttatggaatatattccgggcatctcagtgaaagagtatatcaggattcatgagaagatccccgaacgccggacagctgtatggggcatacagctgctggatattttagactatcttcataggagatctccgccggtgatccactgcgatattaaaccgtccaatctgataatcacgaagagaggcaggctctttctgatcgactatggcacggcaattctggggaaggatgggaatcaaaagctggggacctgcggatatgctgcaccggagcagatggatggactcgggtatgcagatgaacagagtgatatttacagttttggcatgaccttatatcacatggccacaggacaccaccctggtaagaaaccatgggaagatgataaaaactatgggttttccaggggattttcaaaggtgctgaacaagtgcctgcaaaaggataagaaagaccgttatctgacggtatcagaagtgagacgcgggcttaagagagctttaagaaagcgggccgctatccggaccggagcagcagtttttttgattcttgcggcgggaacttgctggaagactggagacgggcaagagcagtctgcatatgctgagctgttatccaaagccgaagaagaacggtcaaaggcagggagcaggttttcgatgaaagcagtccggtattatgagctggcgatcgatcggggcccgggtcaggcaccggcatatgagagactgctgaaatattatcagtctgccggaagggaaaaagaaggccttacagttctggcagaatatgtggagtctaaagactttgatgccgtggggaaggaagctcttttatacaggatgggtcttttatatctccagggaaaagagggaaaggaaggattcccaccggacccgattttggcataccggtatctggcgatgcaggagcatccttcggatatcgaaaaagattatacagaacttgcggggattttatcgggaaagagttatcaggcagacaggctgtgggaaattctggaccggtgcgggaaaaagacagaagatttccggcagacatatcttttatttcagatctgccgacaaaaagagcaggagctgaagaagttcggggatgttgaaaaaaagcaggaggaactggcagatctcatggaaaaattgtctgagaacagtgatgaaaggaggactgcactgcgcgaaaaagcggcatattatgagcgcatgatagacagctgcggccttgaggcatggatagaggccgcagaccggtacacagatatgctggagcaggaaaaagaaaaggcagagatgcagctgaaaaaggccagactgttcgccgggtatgggagaaaaaagagtgcagaggaagtgtaccgggcagtcatcagacagtattcgggatggcctgagggatatatagcatatggtttttatttggcggaagcaggaaagagggatatggcacagaatatgtaccgcagggcaaagggcctcggtgcaggaggggatacggaacttcataaactcggagctgttttgggggaggaaaataattagatgctgaatcgaaaaaagatagcaggagtttttatgatcgtgtttgctgcggcgggatgcacggtttttggcggtgagaaagaggaaccttctttgagggcggagtttgcggatggagagcaggaaacctatatagcaaaggagcgggaacttaaaattactctgctgaaggaagaagcagacagggacaaagtaatctgccgcgccgaagggaacgatggtaaagaaaagtgggatgcaggaaatataacttggctgtcagacaaagaaggcagggttatctttcagagggagggctggtacagagtcagtgtggaatatgatggtgaatccagtatgcttcaggaattttgtctggaaacaacaaaaccggaggagccggaggcggatacgggttcctatatgcagggcacatggacaaaccgccctgtgcatataaatttgtctcagggaagctctttttcaggacgatccggctttgaatacctggaatcagaacagggagagtggaaagaagctgagggggacagtattacagttaagacaaacgggatacacagatacaaagtgcgcgcggtttccaaagcagggtaccggagtgccgctgccgatgtctttgtgaagttctgggataaacagcccggaaaaccaaaggtaaactgccccggctccgcggatggagagtggcacaaaaaagaggtgaggatccgtgcagagaaaaggcagaaaaagggtcccggactaaaaacctttatcacagcaaagaatttggatacggggaggaaaaaaactattgaagaaaacagtcttttgctttctgaagaagggaaataccagatccgagtggttcagaaggatgaggcaggaaatatctcaaagaaagaatggaaaaagaatatttatatagacggcagtaagccccggatcagcctggaaggaaaaacggtgaatctatatgagaaggatggctgcaaactcaaagtgaccataaaagattcctatctggatgcagagagcatacggtggcagactacggggaaagttgtgaatcaaacagcaaaagaaggagtgctgaaagcagatatatattttgaaaaagaaggggagcaaaagctgtcagtctcatgtcaggatcaggccggaaattccgcagaggcttctgccgggcattttttcatagataaaacaaaaccacagcttaaaatcacggggatcagttctcttggaatctataattttgcgccagaggccaaggtgagctgtatggacgatactcctacggaggtttctttatacttaaacggtaaattgttaaagagagagaacgtaaagccaggagaaaacaggaaagcggcgtacccgatgctgtcagaagacggatactattgtgccgaagcccgggccagagacagtgccggaaatacggcatcagaaaaagttttttttactgtcagctgtaagggaacacagatcataccggacgggaataccgtacaccaaagcagttcaatgaaggatcagggatcattcggatttcggatgaaaaatgtagtgccttcttatgtgacagaatttgttgtgaatggccggaccgtaccctatgagagaaagggagattatgtctatataagcaataagtatttaaagaatgggtcaaaccagataaaagtgaagatgaaagatataaccggccatgtcagtacactgaaaaagccattgaatcttcactatgatgcggaacctcctgtgatcctcatatccggggtcagacacggaatcacttatcgggagaaaaagcaaatccaggtaaaagttcaggatgatcaggaccggataacgggtttatggatggacggcaggaagataaagttttcagacggacagacggtgatccggtgcggcacagacggaaatcacaggctaaaggctgaggccgtgggaaggtcggggcttaagtccggcagaacggtggagtttaaaatcagtacgaaacagagaaaacattcaaaacgtccattcgggtttctgatttccgggatctatttccttacggcactttatctcatgtttttctttttccgaagccgaaaatcataagaaacaagttaaaatcttctttattctgtgttataatgaggcttaatgcagaggtttcgtgaaaggagatttaaaaatggcagaagaaatgaaagaaacaatggaacagtatgagaatgaattggaagcatccttccgtaagatggatgagggagatatagttgagggggatgtattgagcgtcagcgacgaagaggcagttatcgatttaaaatattatgctcagggtattctgaaagcttctgaatacagcgatgatccgaatatcacattgacagaagcactccgtgaaggcgacaggctaaaagcaaaagtaatttccgtggatgacggagagggaaatatcctgttgtccaagagagaggccaatcaggttctcgcctgggaccgccttcagaaactgatggatgaagaagcagttctcagtctcactgtgggcggagtcgtcaacggaggtgtgatcgtttacgtagaaggaatccgcgggtttatcccggcttcccagctttccttaaattatgtggaagacctgaacacatggctcaaaaaagaagtggaagccaagatcattaacgtagatgagagcaggaataaacttgtactctcagccaaagaagtggaaaaggcaaaggctcaggaggagcttaaccacaagatggccatgatgcgtccgggcatggtgctggaaggtactgtagaaaatatcatgccgtacggagcgtttgtggatcttggcgatggacttagcggcttgatccatatatcacagttcagcgaaaaaagaattaaaagcccgaaagaaatggtagaagaaggacaaaaggtcaaagtaaaggttttaaaaatcgccgacaacaagatcagtctcagcatgaaggtactggaggaatccagagaggcggaaaaagttgagaccggaattgaatataaggaagaggaaaaggcacagaccagcctcggagacttactggcaaatcttaagttataattcagagaggaatcaaaagatggcaggttcaagcattggcacattattcaaaattacaacgtggggagagacccatggagaggggcttggagtcgtcgtagatggatgcccggccggactttctatttcaaaggaagatattcagcagtacttaaaccgcagaaaaccgggacagtcaaaatatacgacgccccggaaagaggacgatcaggcagagatcctgtccggagttttcgaaggaaaaactaccggaactcccatttccatggctgtctataacaaggaccagagatccagagactacagtcagatcaaagatgtttaccggcccgggcatgcggattatacttatgatgccaaatatggaatcagggattacagaggcggaggaaggtcttccggaagagagaccatcgggcgtgtggctgccggggcagtggccgtcaagcttttaaaggaacttggcattacggtaacggcatacgcaaaagagatcggcggcatcacggcagacgagaaacgatttgatatagaagagatcttccggaacccgttttatatgcccgacagagaagcagcattgaaagtgcaggaatatgcggaccacatgatgagagagcaggattctatgggcggtattatcgagtgtaccgttcaagggttaaagcccgggatcggtgatccggtgtttgaaaagctggatgccaatctggccaaagcagtgctttcgatcggtgccgtaaagggatttgagatcggtgacggctttgcggcggcctcatccagcggatcccagaataatgacgcttatgagtatcgggaaggcagaattgtaaaaaagtcaaatcactcaggaggagtgctgggaggaatcagtgacggcagcccggtcgtgttccgggcggcagtcaagccgactccgtctatcgcaaaggtccagcctacggcaggaaaaaacggagcagatatcgacctttccatcgggggaagacatgatccgatgattgttccaagagctgtggtagtggtcgaatccatggcagcggtcacgattgcagacgggctgcttatgaatctgagtgccagcatggactctgtaaaaaaaatatacggacaatggtgaatatatgtatcagttaataaaaaaagacggaagagcaaaaagaggacggtttacgaccgttcatgggacgatagagaccccggtttttatgaatgtggggacagtggctgcgatcaagggggcagtgagcacagatgatttaaaagagatcagaacacaggtggaactttccaatacctatcatctccatgtaagaccgggggatcggctgatcaaggaattcgggggccttcataagtttatgaactgggaccgtccgatccttacagattcagggggatttcaggtcttttccctggccaagctgcgtaagataaaggaggaaggtgtttctttttcttcccatattgatggacggaagatttttatgggacccgaggagagtatgcagatccagtctaatctgggatctactatcgctatggccttcgacgagtgtccgccccatccagcggagagaaaatacatgcaggattctgtggaccgcacgaccagatggctgcaccgctgtaaaaaagagctggatcgtctgaaccgtctgccggatacggtgaatccgcatcagatgctgtttggaatcaatcagggcggaacctatgaagacatccgtatctctcatgcaaaagagatttccaggcttgaccttgacggctatgccctgggaggcctggcggtaggggaatcccacgcggagatgtatcgtattctggatgaaaccgtcccgtatcttccagaagcaaaacctacttatctgatgggagtgggcactcccgccaatattttggaagcggtagaccggggagtagacttttttgactgcgtttacccgacaagaaacggcaggcatggacatgtctataccaaccacggcaagatgaacctgttcaataaaaaatatgagctggatcacaggcctatagaagaaggatgccagtgtccagcgtgcagaagcttcagcagggcttatatcagacatctgctcaaggcaaaagaaatgcttggtatgagactgtgtgtcttgcataacttatatttttataatacaatgatggaagagattcgggaggccattgaacaggggcgatacagagagtacaaggagagaaagctttctggtatggaaaataagtgatcaggattcaagaaattgaatttgatatattattattttaaatggaggaaaaagaacaaatgcaatcacaatttagtatgattctgtggcttattattgtgttcggaggtatgtatttcttactgatccgtccgcagaagaaaaaagaccagcagatgaaggaattagcggcttctctggaagttggggacagtgtacttaccatcagcggcttctatggtgtgatcgtggatgtcgtagatgacaaaacgatcgttgtagaattcggaaatgacaaacattgccgtattcctatggaacgtgctgccatttctcaggttgagaaaccgaatcagggaacaaaagaagattaatatgcagggacggcgcttttttgcgccgtcttttctgtacccaagagggcgctttaagaaggagtgagtcaaaagaagttggttatcagaagcatccaggaggagtgatcatggacaggacatcgtttccctactattatgatatcgttggcagttttttgcgaacagagacattgaaagctgccaaaagacagtataaacagggtgatatgagtgcagtaaaattaaagagagttgaaaatcaggcggtcagggaactggtcaggaagcagaaagaagcaggacttaaggcagttaccgacggagaactgcacagaagatggtggcatctggattttctttggtacttgaacggaatcgagagaaagaaatataaacggagaccggacattttcagggaagaagagacagagccggagacgcttgcagtctgcagcaggatcagcttcggcaatcatccgtttttaaaccatttccggtttctaaagtcgattgccgggaatacggcgactaagatgacgattccgtcaccggctatgttccatttaatctgctgtgtacactctgagtcataccagtcgattccgctttacaggaatgaaaaagttttgtttgaagatatcgtcaagagttatcaaatagcgctgagggctttttacaatgcaggatgcagataccttcagtttgatgatgtctcctggggagaattttgttccggggaacggagggaggtttatcggaacagggggattgacacagagaacctgtcagagcattatgtctggctgatcaaccaggtgctgaaagtgaaaccggaggatatggcggtgacccttcatatctgccggggaaagttccattctgcctgtatgatatcaggaagctatgaggcagtggcagagcagttattcggtaattgtcttgtggacggcttttttctggaatataatgacagtgcgcaggccggagatttcaggccgctcagatacataaagaatcagaaagttgcgcttggattgatttctaccaggtctcctgtgatggaaaaggatgaagtaattcaaaagaaaattatggaagcatcgtcctatgttccgctgacacagctttgcttaagcccgcagtgcggatttgcctcagaaaaacaacagagatttttgacagaggaacagcagtgggagaagatcaggaatatgaagagaattgcggaggaagtatggaagataccggcaggggcttagagcccgctgccggcggcaaaagattatgccagagccccgcccagggttcctccggctgcgcacagaagcattgcggtgatgcgctctccgctcatcagtgcctggttctgatccaggagaagggagatcagaaagagtacggcaaagtacagaaggcctacggccaggccccagaggaattttctctttcccatccttttgccgatgataaaccctgcaaatacagacgcagccacataggtaaaggttacaccaaggtttgccacttttgtgctgacttcggtctgatacataataaaagccagaatacatagaataattcctgtcaatatgtaggaaaagattaagctttttaagattgaaataccgatatttttattttccatgggatgcctccttttagtaagattttatgcaggagggggtcattctatgacacatagagagaaaggacagacgatgattgacttacatttgcactcggatgcttcggacggaacactgaagccgacagaggtgctgcgtgcagccaaacaaaagggactttatgcgttcgcactcaccgatcacgatacagtcggaggaattccgccaatcctttattcgggagaacttacagatattcattttatgccggggatcgagctttcatgtgaggcggaaaaacacgagatccacatactgggttataatattgatatctgtgatcagaaactcctcgaaacactggaggggctgcgtagaggtagaaggcagagaaatctctccatgattgaaaagttccgtgaggacgggataccgatgacgctcgaaaaacttctgcatggcaacgaagagacggtgatcaccagggcacattttgcaagagtgctgatcgaggaaggatattgtgccagtaaagatcaggcatttaagaaatatgtgggtgatggatgcaaatactatattccaaagccttattttgcgcccggggatgcggtcaggctgatcaaagatgcaggaggcactgcggttctggcgcatccgtttcagtatcatctttccaacgcggatcttgaggaactgatcagggagctgatctcttacggcctggggggaatagaggtctaccattcttcccatcatcacggacagatcgtgaagctcaggcaatggtgcaggaaatatgggatgctggccacaggaggttcggactttcatgggagcaataaaccggacattgagatcgggacgggacggggcaatttaaaggtcccggatcacctctacgatgaactgaagaacttattgtaattccgaaatgaatatgatataatgggcaagttaaaaagggaataagagagattcatattgaaggaggaacttggcatgaagcacattaagactctaacgaataaaacattgcagaacacagtaaagaaaggcggatgcggtgagtgccagacatcctgtcagtcagcatgcaagacatcctgcaccgtaggaaaccagagctgcgaacacagcaaataacccacggtgggaaagagcagaagaatgagaggcggttcctttttgaaccgtctcttttcgttaaggacagataaaggagaagaagcagcgtggtttatcaatacaaaaataacggatataatatggtgctggatgtggagagcggatcagtccacgtcgtggatgatctgagctatgacgttgttgggctttacggcacccacactttgaaagaaatacaaaaagaactttccggatacgatgccggggagatcgaggaagtctatgaggaaatcaggcgtctggagagcgaaggggcactctttacaagggacgagtatgaggattacataacggagttcaaaaggcgccccaccgtggtcaaagcactctgcctgcacattgcccatgactgtaacttggcgtgcagatactgttttgctgaagaaggggaatatcacggggaccgttcgatgatgagtttggaggtaggaaaacaggcattgaatttcctcgttgaaaactcaggcagcaggagaaacctggaagtggatttcttcggcggggagccgctgatgaactttgaagttgtaaaacagctggtggcttacggcaggtctctggaggagaaacacaataaaaagttccgttttactctgacgaccaacggcgtccttctggatgacgatgtgatggagtttgcaaaccgtgagatggccaacgtggtcctgagcattgacgggcggaaagaggttcatgacaagatgaggcctaccagaaacggtaaaggcagctacgatcttatcattgataaatttaaaaagtttgcagagatgcgaaacggaaaaagttattatgtgagaggtactttcacccatgacaacctggacttttcaaaagacgtgctgcaccttgcagacgaaggttttgaccagatttccgtggaacctgtggtaggacccgaagaggagcggtacacgatcaaagaagccgatcttccaaaaatcatggaagaatatgaccttctggcaaaagaaatcatccggcgggaaaaagaagggaagggctttacgttcttccacttcatgatcgaccttaccggaggaccctgtgtggcaaaacgcctttcaggatgcggatcgggaaccgaatatctcgcggtgacaccgtggggagatctgtatccgtgtcatcagtttgtgggggaagatgagttctgtgtgggaaatgtgtttgacggagtcacccgccgtgatattgtctctgagtttaagaagaccagtgtttactcgaaagaagactgcagggagtgtttcgccagattttactgcagcgggggatgcagtgctaactctcataaactgaacggtacgatcaacggtacctatgaagtgggctgtaagctggagagaaagcgagtggagtgtgcactgatgataaaggctgcattggctgatcagagtgaagaataaaggagcagaaaacttatgaagacaaacaaaaataagaagggaagatacgctgtcgggattatcctgctggccgcgttgtgtgtgtttggagtttttatcaccgcaaaggggcttgggaaaaacaagataggccgtgcaaaaaacatcgaactgggtctggatctggccggaggagtcagcattacctatgaagtggacggcaaaaatgtatctgataaaaacattgacgatacggtatataagctgcagaagcgtgtggaaggatacagtacagaatccgaagtctaccgtcagggtaaaaacagaatcaacatcgagatcccgggtgtgacagatgccaataagatccttgatgaactgggacagccgggaactctggcatttatggtccaggacggcaagtccatgaagacagttctgaccggaaataacgtcaaatccgcaaaagcacagacaaccgagggagacaatggggcaaaagactatgtcgtagccctggagttcgacaagaaaggaaccaaggcatttgcagatgccacaaagaagaatgtcggaaaaccgatctatatcatatatgacaatcagatcatcagtgcgccgaacgtgcagactgtcataactaagggagaatgcagcataacaggaatggaaagctttgaagccgccgagaatctggcatcttccatccggatcggatcgctccctgtaaaattaaaggaactgcgctccaatgtggtttccgccaaattaggagtggatgccatccagacaagtgtcaaagccggtgccattggatttgcattagtctgtatactgatgatcgccctgtattatcttccgggagtgatcgcatgttttgcgctggccatctatgtgctcatgacgctgctggcgctgaatggattcaatgtgacgctgacccttccgggtctggccggtatcatactcggtatcggtatggcggtggatgccaatgtcatcatttattccagaatcaaggaagaagtgtcgcttggcaaaaatgtgggaactgccattaagtcgggatttcacaaggctgcctcagccattatcgacggaaatgtgaccacgctgatcgcggtggcagtcctctggtttaaggggaccggaacggtcaagggatttgcgcagacactcggtatgagtgtcctgatttccatgtttacagccctggtcatcagcaggtttttggttaccgccgcatacaaattcggtctgaggagccctaaactctatggaaaagcgagagctttaaaagaacgggatttcatcggagtcagcagacggtgcatggcggcagcgctgcttgtgatcgttgtaggtctggcattcctgccggtcaataaatcaaagattgggtcgccgcttaattttgatttggaattttccggagggacatcttctacgattacatttgataagagtgtaaaagtagacgacagccttgagaagaaggtagtatctgcctacgaaaaagtcagcaaatccacttcggtccagggacagaaagtaaaagcaaataatcagatggtaatcaagtctgtggaattgaaccttagtcagaggaagcagatcgagaataccatgaagaaagattttaaggcaaaatccgttgccactgaaaatataagctctactatcagcaatgagatgcagagggatgcaatcgtttccgtggtgatcgcaagtatctgtatgctgatctatatcgccatccggtttaaagatgtgaaattcggagccagtgccatcatcgcactgctgaatgacgtgctcatcgtctttgcggcatactctatcggaaggctctccgtggggggaacctttatcgcatgtatgcttacgatcatcggatactctatcaactctaccatcgtcatatttgaccgtatccgggagaatatacaggaggcggacaatacacagctgaaaggcattgtaaacaggagtatcatccagacactcaccagatccatcaatacgtcgctcactacgtttatcatggtgtttgtactgttcctgatgggagtgtcatccatccgccagttcgctttgaccctgatggtcggcgttgtgtgcggggcattctcctctgtgtgcatcacgggaccgctctggtactttatgaagacagggtttaagaaagagcagaaggctgctgtcactgaccataaaacagagaccgaaaacgggcaggagaccattgctgcgccaaagcctaagaaaaagaagaagaaaaagaaaaaaggaatccgatagaacatttgaaaactgtgatcagacaagaagtttgattgcagttttcttacatcacgagaaggggacaaaaagttacttatggaaaaatggtttatcagcaagaagaaagcagattttatccggatcggagagaaattcggcatcgatccggtcatagccaggctgatccggaaccgggatatcacgggagaggaggagatacgcaggtacttatccgggactctttcggatatttcagatccgttcatgatgaaggacgcaacggaagcatgcagactgctccatcatgcgatccgtgggggcacaagaatcaggatcatctctgactatgatgtggacggggtgatatctaattatatattgtggaaaggcctcagtgatctcggagggagtgtggactttaccattcccgaccgcatccaggacggttacggaatgaattcggagatggctgtgaatgccaaagaagacggtgtcggactgatcattacctgtgacaatgggatcgccgcttttgatccggtaaaaaaagcaaaagatctgggcatagaagtcattgtcacagaccatcatgaggttccgtatcaaatggaagaaggcagaaagagggagatcctgccgccggcggatgcggtcgtgaatccaaaacaggaatcgtgcgtatacccctataaacagctctgcggggccggggtggcgtttcagctcatgagagcactttaccgaatggagggcagggaggataagaacctggaaccgctgctctgttttttggccatcgccacagtatgtgatgtggtggatctcacggaggaaaaccgcatttttgtgagagaagggctgaaccgaatcggtattactgaaaatactggtctgagggcgcttttaagggtacacaatcttgaagaggcatctgtcaattcttatcatttagggtttgtcatcggcccgtgcatcaacgccagcggaagactggaatcggcggaaaaggttttaagactgttcatggaaaaggatatggccgccgcagaagagacagctcaggaattgaaagagctcaatgaccagagaaagggaatgaccaacgagggagtcaaaaaagcgctggatcagatagaacaaaatggatacggggaagacaaggtcctcgtgatctatcttccggactgccatgagagcatcgcgggaatcattgccgggcgggtcaaagacaaggtgcacaggccggtttttgtattgaccaaaggaagagaggggatcaaaggttccggacgttccatcgagaactatcacatgtttgaagccatgaatgaagtgaaggatgtctttaccaaattcgggggacacgccatggctgcagggtgttctctgtcagatgagtcgaaagtggaggaattccgcagacggatcaatggctgctgtgatcttaaagaggatgatttcataaaaaaggtttcgatcgatgtggatatgccgattgactatatttctgcagaactggtgcgccagatggcggtgctggagccgtttggaaaggaaaataagaggcctttgtttgcccacagaaaacttttcattgaaagaatccaggtattcggcgataatagaaatgtaatccggctgtcgcttttaagtaacaggggaacaagaatgacgggcatgatctttgaagaggaagatatattccgtgaaaagatgggagagggaaagcagtacatcacttgcacctactatccggatattaacgtatacaggggaaatgagagcctgcagatacggatacagcattacttttttacctagggaggacagttatgagccagattaaattggtaaccatggatttagacggaactttgctgaatgaccagaagcagatttcggaacatacgagggaagtacttgaggaagcagcgaggagaggcgtacatattgtgccggccacagggcggatttacaaagcaatcccagattttatcaggaatttagagggagtccgatatgccgtctgctgcaatggggcgacgatctatgacgctttggaagataaaattatatacaagaaccacattccgaaagagacagctctgactctgctcaggaaacttactgaatataattgtaccagagatatttacaggaacggccagggctatatggaaggaaaattctatcatcatttagaagattttgatattaagagccagcagaaagaccttattttaagaaccagacaggagatcaatgatctggaagcctatgtggaagaaaacagtgacggcattgaaaagatcagtgccttctttggtgatctggaagagagaaaacgtgtcatgaaggaactgagtgatctggggattgccagcgtttccagcgcactgtttaataatatagagattactcagatgggatgtgacaaaggagacgggatcacacagcttgcaaaacatctttccataccgatcgaggaaacgatggcgtgcggggatgcagccaatgatacatttatgattcaggcagcgggcttcggtgtagtgatggagaatggaatggatgaactgaaaaatatagcagactttgttacaaaatccaatgaggaagacggagtcgcctatgccatcgagcggttcgcgctgaactaaaggggaacgaaagatcatgaagcttttgcatatggctgacctgcatttgggcaagacagtaaatggaatgaatttcatagaagatcagagacatgtgcttacacaggtactggaactgatggagaaggagcccgttgacgggctccttttggcaggagatatttatgaccggagtattcctccggctgaggctgtgaccttgtttgactggtttctgacaggtacggcaaagcttatggtgcctgtttttttagtggcgggaaaccacgattcgggcgagaggctggagtttgggcagaagcttttcggacagcagaacatttatatggaagggacgcttagagaagaattccccgctgtcaggctggaagatgaatacgggccggtctgcctgcacctgcttccgtattttaagccggctgaggcaagagcattgtttcctgaggatgagatccgcacacatgaagatgccatgcgctccgtcctcgcccgtcatccggtggacaggacagagcggaatgtgctggtcacccatcagtttgtcacagggacggaacctgtcaggcagtctgattcagaactgttgctgagtgtgggagggacagaacagatttcttacaccatttttgaagactatgactatgctgcacttgggcatatccatggccctcaaaaagcgggaagggagaccgtgagatacagcggttccctacttaaatactctttttctgaagaatttcacaagaaatctgtgacgctggttgaattgaaagaaaaaggcaatataacactgacagtctacccgctcaggcccagacatgatatgcgccggatcaaaggaaaacttggagacctactcgatccgcaggtggttgaggccgccgactgtgaagactatatcagcgctgtgctgacagatgatgaggaacttgcagatcctatggaaaagctccgtgcctcttatccgaatattatggaactgaacctggaaaaaaaacagagatccggtggcggtgaggtttatgccgatgtccgtgaaaagacaccgctggaactcggggaatcgtttcttaagctgacctgcggtgaggcagaagaaaagaggatggaatttcttaaaaaacttctggaagaaggaggattggactcatgaagccattatttctcgagatcagcggatggggtccatatgcgggcaaaaaccagattgatttttcaaaatttcagggaggactgtttttgatcaccgggcctaccggctccgggaaaactacaatatttgacgggctgacctatgctctctacggagaagtcagcggaagcatccgcacgaaggaaaatcttaggagcgatttcgcttcacaaaaggaagatacctatgtgatcctcgaatttacacacaggaatgagaagtaccgggtagagcgccatccgaaatataggagagccaaaagaaaaggttcgggaatgacggtaaaaaaagaggatgctgtgctgactttgcctgatggaactgtaaaagcgggaacgtccaaagttaacgaggagttagcccgcctcctctctattgattatgaccagttccgccagatttccatgctggcacagggggaattccaaaggctgctcatagcaaaatccagtgaccgggcagaagtgttccgctctatttttcatacgcagatctataaaagaatccaggctttggcaggtgaaaaagccagagctctgcttggtgaaatacgtgagatcacaaatcagatggaagaggcggccaaactgtcaggagaagatccggcatacgaagaaatgagggaaaacaaagatttcccgtctgtgatcgcttatcttaaggccgattacaaggaaaagaaacagcaggcagccgaggctttaataaacagcaggcataagagagaagagtttgactcaaagaaacagatttttgagcagtcgaagacaatatctgaggaggcagaaattctggcttccaagatccgcagtctggaagaggaattagtaaagcttaaagaaaagcgtgagaatatccggaaaaagaagcaagaactttacagcctcagggatgtgatggatcttaaaaaggagcgtctcggcgcattaaaggagatcaaagaccaactggaacgattgggacagctggaaacagaatatgaaaaagccagtcagaaagagttcgggcagatcaagaggaccaggatggcagtttaccaggaatggcttgaagcagaggaagaggcaaaggcttcttctgagatttttaagcgtctctcagatgaatttgatcaggctgaatgcgagtaccggagggcagatacattaaggaaagaagaacagggcacctatatggagatgcagtccgctttttatgcgggcagcattggcattttggcaaaagatttaagggcaggcaaaccatgtcctgtctgcggttccatggagcatccaaagccggccagggttccttcaaaagctccggacagggagcagatggaggcacaaaaagaccgggcagaaaaggcagaagaacttttccgtaaatggtatgaaaaaatgctggaattgaaagaacagaagaatacggcagagacacaatggaaaagaaaacaggaagagctcggagaagaacctgaatatgaggagatcacgcgagaagaagcctgttcagcggaaaagctttccaaacaggaggaagaaagatgtctggcggacatcagagaacagctgatgaaggcagaaggccagatgagggcgttcagagaacagctgaaatcgtggggcaaagcggaggaactccaggaggagcatctcatgctttcaaaagagctggaagaatatgaatccgggaaagaccggctgacggcagagagcatcgagtcggaaacggcgctttccaagacgcggactctcctggaggaacgccgtgcggattttgaggaaaagcagaaacagcaggctgagcttgaacgcgggaaggtttcaagaggtgatctggagaaactggaagaagagatcaaaaaaacagaggaggaaagagaacagcttgccgtgcttgtgcatcagagacagagggcactttgttctttaaaagagaagcagaaaaagagagaaaagcttgaagagagttacggcattgtgggagatgtggaccggcttttgagcggaaataatgcacttcgtctgacctttgaacagtttattctcattacttatttccgggatattttaaaggccgcaaatatcaggtttctgaaaatgaccggagggcggtatgagatgtttcggagtgagacagtcacagatgccagaaaaaaagataatttagaaatagaagtaatggattattataccggaaagcgcaggtctgtaaaaaccctctcgggcggtgagtcctttaaggcggcactgtgcctggcattgggactatcggatattgtcaggaacagcgccggaggcattgagatcgaagttttgtttgtagacgaggggttcggttccctggacagtgaatccttagaacaggcagtttcctgtctccaggagctctccggaaaaaacaggatgatcggcattatttcccatgttccggagctgtctgagcggattgaagaaaaaattacggtccgtaagaaaaatatggggagtatcattgagaaattgtgagaaaaggattataataaattttgggggatggagaataaatgagtgagctaaggagtgaatacagaatgaacaagcacatgaaatccatctgctctgctgtactatgcggctgccttgtagtgggcagcaacacgtttgcatacggtcaggaagcggcagcaacggcaaagacaacagaacagagctcggcaacagatcagacaacagcgtccgaaagcacatcgacaacggctgcacagacagaagccacaaccacggcacagccgcaggagacgacggaacagcagacgacaacggcgcataaggaccagaaaacgacaaaaaagaagaaacagacatctaaggcttctaacaaaaagacaaaaaagatcaaacagaaaaacaaagtcaaaaagctgaaaaagaacaagaatctgaaggaagaaaagacagtttccaatattatccccaagatctacaatgacacgcgtctcagcatgaaggataagaaggaaaccatcgcaggttttacctattttaatcagggagattccgcctggaaccagaatggctactgcattaagagcagcggctgcggacctactgccatggcagtgtgtattacctcgctgaccggcaagtgggtaaccccgcttgacacgactgtctgggcatatgagcatggttattacagtaatgcaggttctgctcatgaagttgtgccggccctggctaaaaattatcagctgggctgcaatggactcggaacggactataagaagatcagggatgcgcttaaaaagaagcatccggtagtcggtctcatgggacccggctattttaccaaaggaggacattttatagctctggtggcgatcgatgacaaagaccaggtcacggttgcagacgtgggaagcagacagcgcagtacatacaagtaccgtttaaaagatgtgatcgagcagtctaaatctgcatccgcaggagggccgttctgggagatctataatcccggaaagaaagagaaagctgcactgaaggccaagaagtcaagagatgatgcggaaaagacaaaggaacagcggcagaaacagcaccgctataatgacttaaaagcagtcctggtgcagcaccagagcgttgttgttccattaaaaaggggaaccattgtgacggaagaaagctttgtgactctgttggatattgattccagggatcatgtatccgtagaattaaaagaacaggtgatcaaagattattctttgaagacggttgtggatgaactgcagacgaaggcgatcagccagaccttctgggagatgacccatccgatggaaaagagccagggacctaccctgtctgatttcttaaaagattaaactgagcaataagcaatacggtctgaaccgcggacagacgcggtcaggctgtattttttctttaataataagagtgaaagggttcaggcgatgaggtggatttgtctgctttgtttttcaaggaaaccgtgaatctggaaacttttttaaaaaaaatttaaaaaattgttgacatttttcgcattattttatatactaatttttgtcgcgagacaagggatcatagctcagctgggagagcatctgccttacaagcagagggtcataggttcgagccctattggtcccattctttatgcggaacgcataaggatatggcgatgtagctcagttggctagagcatacggttcatacccgtagtgtcagcagttcgaatctgctcatcgctatgaaaagacatgtttttttagaacatgtcttttttttgtatcttgcatggaattatattataataaagaaaatgagatattctatatagatgacagaaaaatatgaaagcgaggtatgggatatgagagttggaatgggatatgatgtgcataagttagtagagggccgtcctttgattttaggaggcgtgcatgttccatacgaaaaaggactgttaggccattcagatgcagatgtgcttctgcatgccatctgtgacgcattgctcggagccgcggctctgggggacatcggccggcattttccggatacagaccccaaatataaaggtgtggacagcatgaaactgttaaagaaggtcagggaactggtggagaaagagtgttatctgattgaaaatgtagatgccactgtgatcgcacagagacccaggctggcgccctatattgaagatatgacagagaagatcgcagagacactcggagtcggaagaaaacaggtcaacgtaaaggcgaccacggaagaacatctgggatttaccggtgaaggacttgggatcagcgcccaggcggtctgcatgctgactgcagtagataattatatctatgaagacgtattgaggccgggcgcacagaccggatgtcagggatgccagggatgccggaaaggggaatagatggaacttgtttatgacgacaaaagccacagggatctgatttttcagatgtatcaggatatttttaaggaccctgaaaagtttgcggagtattattttgatgtgatctatcctaaaaatcaggtgctcatggcatgggacggcgtctggctgcagggaatgatccacctgaatccgtaccgcatgaagatctcagacaaagaatttgatgcacattatatcgtggctgtggccacaaggaaagaaatgaggagaaaaggcgtcatgcgaaaaatgctttgcagggtcctcaatgatatggcagagcgaggtgagccgttcacatatctgatacctgccgacaaggcttactatgaacctttcgactttgtgtttgtgatggactgggcagagacagagatcacaggggaagcgggcgcagttacaggttctccggaacagttccggggagatgatatgcaggaagtacttcggttcttaaaccggcagatccggtcatatgatatttatacggtgatagatcaggattatatacagcaggcggcaagggaagcaaaaagccaggacggagacttgatggtgttcagagagcacggtgagataaccggagtttttgcatacggaaaagaaaaagatacagtatatatacggttgggattcggtacagatgagaaaagatttttagagatgatcagcagaacatttccggacaataaaatcgagatatccgcgggctgtctgaaacaggggaaaaaggtcccgaagatcatgttcagaattacatcccttgaggcgctgtgccgctgcctgaagagcagaaagaaaacagaatttattcttactgtaacggaccctgtgatcgggaagaataacggaactttcctgttttccgcctcaaaagacgggacagaaatccgcccttcatccaaaaaagctgtgggagagctgtcgatcggtgatttctcaaaagcagtatttggatacggcggggaggaagtattggagaggcatccgtgtctgagagaactgataccattggacgccgtatatattaccgaggaggtataactatgaaattaatgtttatcggagcagaccatgaagtaacgggcagctgccattacgtggaggcgtgtgggaagcgttttttggttgactatggaatggagcagggaaagaatgtttatgagaatgcagaacttccggtgaatccgtcagaaattgactttgtgctgctgacccacgcccatattgatcattcgggactgcttccgcttttatatgccaatggcttcaggggcagtatcattaccacaaaggctaccaaagaactctgtgacatcatgctccgtgacagcgcccatattcaggagtttgaggcggagtggaaaaaccggaaggccagacggtcggggaagccggaagagcctcctctgtatacgatggatgacgcggtaagtgttatggagcagttcataggctgtcagtataacgagaaattagaactgagccggggcatcagcgtccgttttacagatataggacatctgctcggctccgccagcattgaggtatggctcaccgaggcggacacgcagaaaaagcttgtcttctccggtgatatcgggaataacaaccagcctctgatcaaagacccccattatacggagagtgcagattatgtggtaatggaatccacatacggagaccgttttcatgaaagtcatcccgattacgtcggtgaacttgcaggtttgattcagaagacgtttgacaggggcggaaatgtagttatcccgtcatttgcggttgaaaggacccaggagcttctgtactatatccgccagatcaaagaggagcgcagggtgaaggaccacggagattttgccgtgtatgtagacagtcctcttgcagtggaggccaccaacgtttttcaggaaaacatacatgatacatttgatgaggatgccatggcactgatcaatcagggcatcaatccgatcactttctccaatctgaaattatccatcacaagcaatgattccaaggcgatcaattttgatgaagaccggaaggtgatcatctccgcttccggtatgtgtgaggcgggaaggatacggcatcatttaaagcataatctgtggaagcctgaaaataccattgtgtttgtcggataccaggcttacggcacattgggccgtgctcttgtggaaggtacgaaagaagtccggctgttcggtgagactatcaaagtagaagccgatgtggtgcgcctggaaggaatgagcggacatgcggacaaaaaaggactctctgtttgggcggaggcttttaaagaccagcctgaaaaattttttatcgttcacggagaggatgaaacctgcgacagctttgcccaatacctggaaagtgaatgcggcaggaaggcggaagcaccgtacagcggagatatttttgatttagccgcaggagagtgggagctcagagttgcgccgaaaaaagtgccggaaagcaggaagagcacgagaagagccaatgctgtatttgcaaggctgctggctgcaggtgagcgcatgatgtctgtcatacggaaaagtgaaggcggggccaacaaggatctggccagatttgcggatcagatcaatgctctctgtgacaaatgggagcgatgacagcataagagcattatgagatgcgatcatgaaggaggaaacagatgaaggttttaaagtctgatgagatgctgtgcgaccactgtgtggaccggataaagataggtcttatggacgcgggcattgaagcggaagttgaactgagtgacaaaagtatcatccttccggaagatgatgatacactgatcgaaaaagcaaaagaagttttgggggagctggggtattttgcacaggaaatataaaatacccggatgatccgggaactgtctatagagacgtgcaattttcaggcaatcgtgatacaattattaagtatgacatttttaaggatatgggagaaacgatgaaggaagagagacggaatgaaaactccgccgtgaggattaataagtttttaagtcaggcaggcgtgtgttccagaaggcaggctgatttttatgtagagcagggcaaggtgacggttgacggaaaaacagccgagccggggacaaaggtttgtgaggggcaggaagtctgttttaatggaaagccgatccggatgaatactcagacagtatatcttgcatacaataaaccgaaagggatcgtctgtacatcaagcaaagaggaagccaacaatatcattgacgccgtcggttatccctcaagaatctatcctgtgggccgcttggacaaggattcccagggactgatcctgctgaccaacgacggggaagccgccaatgagattatgaaggccaggaattatcacgaaaaggaatatgaagtgaaagtcagcaaaaggatcaccaatgactttatccagggaatgagaaacggtgtgcccctttcagagcttgacacagtcacaaggaaatgtacggtcaaaaaagaaggtcccgagaacttcaggatcatcctgacccagggcttaaaccggcagatccgcagaatgtgtgaatattttggatacagggttaccaaactaagaagagtccgggtcatgaatatcaggctcggcaatttgaaagaaggatcctaccggaagcttacgccggaggaaataaaaaagttaaaagaggaactgatccgtgaaagataagtttgaccgaatgaaagagctgatccatatcctgagtgaggcatccaaagcctattatcaggaaaacagagagctcatgagtaattttgaatatgacaagctttatgatgaacttttggagctggagaaagagacagatacggtgctggccaacagcccgtctgtccatgtgggatatgagcttttaacttcactggaaaaagaaccccattcctccccgatgctttccctggacaagacaaaagaggtgggacagctggaagaatggctgggagaccaaaagggccttttgtcatggaaactggacgggcttaccattgtccttacgtaccaggacggcgtacttttaaaagccgtgacccggggaaacggggaagtgggagaggtcgtcacaaacaatgcaaaggtatttgtaaatctgcccaaaaagctcgcatacaaaggaacccttgtaatccggggagaagccgtgatccattattctgattttgagcggatgaacgaagagatggaagacctggacagcagatataaaaatccgaggaatctttgcagcggttctgtcaggcaactgaacaatgaagtgacagccaaacggaatgtccgcttttatggtttttccgtgggggatgttccggatgtggattttcataattctgtagaagagaaattcatctgggcaagatctcttggctttgatatcgtggattatgtggcagtgacgaaagatacggtggcagaggaagtggaacgcttctcgcaggccattgagaccaatgatcagccttccgacggactggtgctgatctatgatgatattgcatacggcaggagccttgggacgacagccaaatttccgagggattccatcgcttttaaatgggcggatgagattgcggagactacactgaaagagatcgaatggagcccgtccaggacaggactgatcaatcctgtagcgatctttgatcctgtggaattagaggggtctacggtcagcagggcaagtctccataatatcagcgtgatggaagaactggaacttggcgtaggagatcagatttccgtatataaggccaatatgatcattccgcagcttgcagaaaatcagacaagaagcggcgatgcaccgatcccggatacctgtccggcctgcggaggaaagacggaaatcgaggaagaaaacgggatccgcaccctggtctgtccgaatcaattctgcagtgctaaaaagattaagctgttttcgcactttgtatccagggatgccatgaacgtagacggactttcagaggcatctctgcataagatgatgaacaagggtcttttaaacgaactgtacgatttatttaccctgaaagatcacatggaagagattatagagatggaaggctttggggagaagtcctttcataacctggtggatgccgttgaaagagccagaaaagtgacacttcctaagttcttgtacagccttggcatcgccaatgtaggtctgtccaatgcaaagctgatctgccggtactttgaggatgacctggatgccatcagaaatgcggatgccgatgatttcacagtcattgacggtatcggaccggtcatcggtgatgctgtcagcggatacttccgtctggaaaacaacaggcagactgtggatggactgcttcagtacgtggagattgagaagaagcagcccgaaaagacagagaaaatattggacggcaagacttttgtcatcaccggttctttagagcactacgaaaaccgaaagcagctccaggagcagatcgaactgctgggaggaaaagcgaccggctccgtgacgaaaaaaacagactatttaatcaacaacaataaaaattccacttcatccaaaaacaaaaaggccatggagctttccataccgatcataacagaagaggaatttatggacatgataaagtaaggaatgatgaaaatgaaacgaaggttaatttcatggatgctggcggcggtgatggtcatgacatctgcggccgtatggatgggaaatgagaaacaggcagaagcggcagctgcatttaaagtgcattttatcgaggtaggcaccggagacggtgccctgcttcagtatggatcagggaaaagtgcaaaatatgcgctgatcgatgcaggacctcagacgacacagcttctgggaggaaaaaccatagatgtcagccgtagagtacataattacttaaagaaatataaaatccgcaggctggaatttgtcatcatgactcatccgcacaaggaccacatcggaggatttatttccatactggaggacagatcgatctctgtgggaagggtctatgcgacccggcagccggtttattatcattattcgggcgaggatgatatttacagctcaaaaatctaccgcgccgtcaataaactgatagagaagcggggaataccggttgttgtaccgcggatgaaattatctatatatcttggaaacgcaaagcttacattttattcaccgggacggaccaattttaaatatgggcgggaagttgattttaattcccggcaggtcaataaattttcccttgtatgcagaattacttatggaaaaaattcatttctgatgaccggggatactcagcaggaatccgagtacgatatgataaaccagagacttaaactcaaatcccaggttctgaaggtgccgcaccacggatatgaggatgtgcgcaataaagatgcgaaagggaagttttcatcgaatcacaagaaattttttgacaaagtacagccggccatatcgattatcagcaatggataccgaaataaggacagagtgccgtccggtctgatcacgagggaacttgccaagtctaatatttatactacgggcgacaatggcaatattatcgttacttccaatggaagcaggctgagcgtcagcacatccagaaataaaaatgagccggccagggccagcacttatgtttcttccaagaagtcatcactgctcctgaaaaagatgtcggtgaagtccagcgggaagaaaaaactgtctatcgtgtcagtcaatgcgaaaaacaagtataaggtcaaagaaaagaaacctttgaaaatctcaattaaggccaaaccccagtcatttacaaggactaagaatgtccagtacaagctggtcaaaaaggggaaaagcagtgccaaataccgatggaagaccggaaagaaggacagggtaaaaaaggatttaaaggatgtctttacataaaatacaatactacttccggaagcacgattgtaaagacaaaaggtttcgtaattaaaaagaagaaaaagtagagaacaaaggagcgtgtaaatatgccgattagaattgatacagacctgccggccagggccatcctggaggaggaaaatgtctttgtgatggatatagaccgggcggtgacgcaggatatccggccgcttaggattgcgatcctgaatctgatgccgaataagctggatacagagctgcatttgctccggagtctctccaacactccgctgcagatcgatattacatttttaaagacagcctcttatgagcccactcatgtgccggaatcccacatggagaaattttatgtgtactttgatgaggtacgggacaaaaaatttgacggaatgatcataaccggtgctcccgtggagctgaaagaatttgaagaagtggattactggaaggaagtggaggagatcatggaatggacgaaagagaatgtcacttccaccttacatatctgctgggctgcccaggcagggctttactatcactatggggttaagaaaaacgttctggaccaaaagatttccggtgtgtatcggcactatccgcttcacaaaaagacgctgctggtaagagggtttgacgactacttttttgtccctcattccagaaataccggtgtggacggcgaggctatcaaacagtgcagggagctgacggttgtggcggaatccgaggagacggggccatatctgattttaaacgagaccgggagccagatcttcgtcacagggcatccggagtacgatgtcatgtctctgcatcaggaatatataagggatataaaccgcggattaaaccctgagataccgaaaaactattacctggatgacgacccgaaaaaggggcctgtaaagtcgtggagatgccatgccaatgccatgtattataattggctgaattattatgtttatcaggcaaccccttacgatctgtaggaaaattgtgtagaattggtgtcaacaaaaaagtaacatgctgttatgaaaaggctttaatataatggatatttaaagaatcattgaaaaaatcaatggttcttttttgtgtgaaattaaataaagaaaggaggattgcaaatgaaagagatatctatcaggatgcccttggtatcggtatttgttttttttaaatcaaaaaaggcatatactcataggagcatacaccttgtatcatataatttcttgtgccgatatgctgtttctgacctgtcgggtagaaaagacagggtgtgaagtgcagtaagttcttataaccttataaatcgttgcatatcggcatttttgtatttgctttgtctcttatttcttctaatagtaccccccctgttagataacgggggctttgaacggctcgctgacactcgccagcatagctggcgtggctctatgtcttcgatcgccaccgtgtctggatcactctgtcggtttgtaaaattttaagcttattccctgcataaacagggatttgataaatactttgctaactaatatttcctgataaattcattaaaatatcaggataaaacactagataccccatttttttacttgctaatcttctgtcaattatgtcaagtaccgcagatataatcagactgatagatacagcacctaatactattggctttacactttcggttaaatctccaaaaagcaacattagcataaactctgctccacctagaagtgtagaaacctgaataatcctaataatatatttcataattatatatctcctttcatagccgaaatgctttattttgacaacttccaatctatcactcgccatataaactggaattgaacaaaatcgctgcgcgatggcctaccaaggctgtgacatagcgattttctgttttctctgtctaaaaaacgataaaaatattcatccgtttcggttcattgaaaacgctgaaaatccagactgtacagctgcattgttgagatttgtaaagcatttggatgtaaaatcagttgaaaagattatagacgggatccctgagaactttcaagatatgcagattatagcagcgggacaaaaagaacataataaagcagtattccatatgatgctaaacaaaagcattttcccagctgcagaaaattttttagggagaaacataagtttatgagtaaaaataataaaaaagatgaaaaggaacagctggaagaaaaataagaggcataatgcttgttgaaaaaagattgtggttatttcataattttgctccattaccgcagggaggacttttcagagtcgtccctgtggtaatggagcattaattttacatgttcttaaatatctgatatatctttgtataattcttcttatcatcctcactctgcttcactccagtgtactccgtccaatcactgtcgcttcttccgggcacgttataagtacgggggttttccgtcaaaagaatcggaagccgacaatgtctctcgccgtacagccacatatccggcatttgtattcggatttctcggcaagagatttcaggtatgcggtgtcgtacttgcctgatccttccagctcatagatctcattggcagtgagagccctcagaagccctgctttgttgaccaggcatgctttcttctgagcatttgtaatatagccgatcagggaaggaatcaaaagagccagaagtattgccaggagcaagagaactacaatgagttccattaaggtaaatccctttttgttcttgtatctgtatgacatcacagtatggtcagctccttcccacatttttcttttggtatagtatatctgcctaggatcaggtacaggaaaagagaaatctatgttaaatcactgtgaaacagaggcttcgccttcggatctgcagctgtcccttttctgatgcctacactgtctgaatgcgggttttctttctgtgggcatttctcactctttgacggcattttggaagcatatttttcagtttctcccattcttcatcatccgcattttttgccagcttttcttccagcagatgggactggatgatcaggctgtaatagagctgtgtatccgtatcctcctgcctgcatatttgtgtcagcagttttgtagctgcggcatatttattccaaagctgttctgttgcaagtctccggctgaatggaaagattacgaggttgaagatcagggagacaaggattccggctattatatacgccagacggattgccagcatttctcccacactgctccacccaaagacatcggtaaagacggcggcgcccagagcaccaatggtggaacaggcgaaagtaccggtatagtctgtaaagtaaaaggaaaggtacccggataacatcataatcgcagtgcggcctgtcatagacgggacagccgcatacaaaagcaggctgaggagaccgccggctgctgtggcggcaaaccttttctttgccttctgtccgatgtcgtcggcatacggcagagaaacagaagcgatggtaaacagcagccatttcccgtgaacaagatgcatggattggacaaacaagcatgaacatgccaggagcagaccgacgcgcagggcatatacgattctgacgggactgatatccagggcggccttaaggcggatggaaagagagagcatcgtcttccggtaccgggtcttttttttcggatccgtcatatggaggagatgttcccgcagataggtaagcccgtcaaatagttcatttgccttggaatcctctttctgagacagaaattcagaccaaaggagcggagggagctctttgatctgtccctggacaaactgccggaagacagagagcttttcggagacggagcaaagcattttagtctggaagacagagagcggctgttccataccggaaaggatcagaaacagatgttccataccccggccggaatcaattactgcaaaatcagcatctgaaatgcacaaaatccttttccggcggtcataaaccatacggcttaagcggaacagattttttctcacgtcttccggtgtgtcaggggagccttttccggtgatcatataatcgatcagattgcacgtctcatcaatcatatcagacagcgcatctcttgtggtctcaacaacccgtttacggcccataatgaactgatacagaatgatgcagacagcacctgtgatcatggcggccagacgctttggcagcagatccggtgtaatcggtgatataaagatcaggaacaaataggacagtatgtacgggaagtaaaggtggctggaatgctcataagtaaaaacataaaggatcagaaagatcattccgaagttcagcggaaatgaaaacacagggggcagtgtgtttacaacacaggcggagacagccatggctgcaaggacagcagcctggcctgccagatgttttaccggtgaagcggtcatatcctttaacatggaagatgccatcataatggtaaaaataacaccgacgatggaattctccatgccaaatactttctggaatactgtaacaaaagtaataataaaaataaaatccagagtggcaaatctgaaattcttcttcagactttcctggcaggaagccagtatctttttagtcttattgttcaattagaatgcctcctttcagcaattcataatggtatcatgccaaaggaccttgttcaagaacgtcacttttggcttttttttcgtacacgaacaatatgtccctataaattttgacaggattcattcttgccaaggttaaattgcttaggcaactatttgctctgaacatcctttataataaaagcataccaacaatacaatctttttaagaaaagagagagacattatgaaacagcaagtacagaagttcggacgtttttttgagcggcatggtgctgccaaacatcagtgctctgatcgcatgggatttttcaccgcgatctttttgcagggaggatagcttgtgaaaaagctggacagtctgctgaaaaacaagattccgacaggctttgagatgctttatgacaattcttcagcagaaattctcgtaatcttaaacaacgccattcagtatggcgtgctgacaccgcttggacttgcagacgcggccgaggccggaaaatcaatctactttctcctcgaaggcaacttgggaccgggactcggagtactcattgcatgctggttttttggaaaaggagaagagcatttaagagaccccgaaaacgtgtacgagaccccggtatcatcgaaaaagtgggagagaaatagaaagggaagtacagggaatgcagcctacacgatcattccgggaggctagaagccatcatccatgccggagaacttttgttgagaagcggattcatcaacgaaatgcttttacaggatgagaatttttccgtctatcttgaaaatatgcttgccattgcccatagagagaaagcggtcagagaccagatccctgggacagagaaagatttataatcggcggcgttgaatttagagtcttgatatgatagcattagctatggtatcaaggcttttatattattccataggaaagtcctaagaaccttcctatggaataatatagccctccgggcatgatgcgcacaaatgcgaaaggaacctatttgactacgtcaaatcgcatttggcgctcaaagttgtcaagcccttcaaagcttgaggggctggggcattgaagtgggattgcccactttgttttgcggagtttatggcagataccatcttacagcgataactattgttcatagaaaggatgcccatgattagactaattgcaacagatattgacggaactctggtagaagaagcagctatgaatctgaatcctgaatatttcgatgtgatccgggagttcagaaaacggggagttttgttcgtagcagccagcggacgtcagagaaaaagcattgagcgtttttttgaaccgatcaaagatgatattattttcctgtccgaaaatggtgcctgtatcacatccagagaatataaacatgtagatgtgatggacccgttcatcgtcaaaagcataatggaggatgcaaaggagattcccggatgtacctgcgctctgaacgacggggagaccagctattttgactccgaaatgctttaccgccatatgaaggacgactatggatacaatgcagtgatggtggacgatttattcaaagtggaagcaggggtctgcaaagtgtctgtgttccacaaccggaatgcggaagatgcggtaggaaaagatttttatgataaatggggaggcaggatctacgttgcgagtgcaggagagaaatgggtagactgtatgaaccttggagtaaataaagggaactctttgaaacgttttcaggagcattataatatttctgcggatgagacactggctttcggcgataatatcaacgatattgagatgctgaaacgggctgcccacagctttgccgtagccaatgccagggaagaggtgaaagaagccgcaaattttgtgacagattccaacaaagaagacggtgtattaaaagtgttaaaggcagtacttaggggggaattatgttagaagcagttatttttgatatggacggagttattgtagattctgagcccggatattataaagctttgctcagactgttggatgaattcgatgcatatgtggatgaagaatacaatgcccggtatttcggcactacgatggaaaagttatttacggataccattgaatatttaaacctggatacgaccgttgattattgtgttcggcgttttttcgagatctatgaagaagtggttgaggaggaaggatttaccccgatcaaaggagcattggagctgatccattctctccataaagaaggaattccgacagcggttgcatcttcttcaccgatggatcacatcgtaaggatcacagagaatttaggagtcattgactgttttcgtgcgctagtgacaggagaagactgcgaacattccaaacctgatcctgaagtctttttaaaggccgctggacagcttggaatcaatccggaacattgtgctgtggtggaggattctgtcaatggtgttctggcaggcagcagggcaggtatgaaggttctcggtttcagcaatcctgaatatggaagtccagctcatgaaaaggcacacaaagttgttcattccctggaagacgtgaatgtaactactttgaaaggattatttaattaaaatacataaatggagaggaaatagagtggaagcagttattttcgacatggacggagtcatcgtagatacagaacccggcttttttattgtggctaataagtttctggagcgctatggaaagagtattaccaaagaatattttgaacaatttttcggcggcgcatcggtgcacatgtggaagacaacaacagaaatgctgggactggatgttcctgtagaggaatgtctgaagggcacgcacgaaatccgggaacagtgtctggtgatcgaggattccagcaacggagtcacggctgccaagagtgccggaatgagtgtgatcggattccggaatttagaggttgcaaatcagggactaaaaccggccgaccatgtagtgactcctatgaaagatatcactctggaattgtgcagaagtttttaagaatttatatagacgaaataaatctctccgaagatgtttggggagatttatttgttacaaaattgtgacgatatattgattatatattaaaaatatgttatgttaaaattgaaatagagtaaattacttacaagatatgcttcaaggttctgggggagtttaccagagaagacaagaagaaatgaggtttattatgaaagcgggcatgaaaaaatgtatcagttacttgctgacagcagtatttgttatctcggctgcagtgacagcgggaggactgcagaaaaagcaggtccgggcagcggaaaaatttcagatccattttatagatgtgggcgcaggggatggagcgctgcttcaatatggggaaggaagcagtgcggagtatgccatgatagacaccggggctgactattatacaacaacaaaaggcgagcagattaccacagaagactgggcatataattatctcaggaaaaaaggcgtcaaaaagcttaaatttatccttctgacccacccgcacagggatcacatcggaggtctcggaagaatccttcgggatgatgatattgaggtcgaaaaaatatacggaaataaccggaatcttacttattcaggagcagacggcagcaataaagagttcaataaagaattttatacagaaacattggaagccattgattcctatgcagagagaaacggaaagggcgatgatttttatgaagttccccagatgggaagtgtggcgaatatcggaacagtacggcttcagttctatggcccggtggatgaaacttcatttcagtatggaagaaaagtgaatctggatgtccgtgagattaataagagatctattgtatgcaagattaccaatggcagcaatacgtttcttatgacaggagatgcacagagacagacgatagatggaattgtgagaaaagggtacaatctgtcggctcaggtgctgaaagttcctcatcacggcatgcaggatgtgacagaagacaataaaattggaaaagattatccgtctgaccacaaatatttatttgacaaagcaaatgcatcaatttccgtagtcagcaatggctatgacaatgacaatgaatcacctcttccaagggtgttaaatgaattggcgggttcagatgtctatctgaccagcaaccgaggtacggtcattgtatcctctgacggaacaaacctgtctgtccagacagaaaaagggaaaaatgcaccgagttacgcaggcgattataacccgaaaaagaaatcgtcaccgacgatgaagagcgtcatcgtatctaccaacggaaaaaacaagctggtgccgacgacttacagtgcggctaacagctataagctttatgaaaagaaaaatgtgacggtcaaattttcagggacgcctcagccgtttacgaaagtaaagagcgtccagtataagtttgtgaaaaaaggcgtggacaaccggacagttccttaccgcagcggaagctccgtggcagtaaagaacggatcggtgggaagaatttatgtaaaatacaatacatggctcggctccactgtcatcaagcttccgggatttacggtcgatacttctgcgccgtccagtgcaaagatcaagggcagcaagtcaggcatcaagacttataagacatctgcgaaaaaccgctataacaagaagtataagaagtccattaaacttacattttctgcctcctacgggacaagcgggaaatccaaagtccagtataagatcgtccccaggggcaagaaaaatacaaagtataaatggaaaacaggaaacagtgtgacgtataagaaaaaaaagaaatgggtccgcgtttatgtgaagtttaccgacaaatcaggaaatacgactacgagaaaaacaaacggattttatattaaaaaataatagacaaatgaaaaaagatggtagataataggatagaaagaatgaatgtcgtcagtgtaagctgacggcattttaaatatggaagattataaaggagaagtgatatgagaaaaacaaaagtaacagttctgctgcttctgatggcacttaccgtatctttgctggccggatgcggcgggaaggaagaagaaaaaacaaaagacggatatgcaaagaaattgtacctgtataattggacagaatatatcccgcagagtgtgatggatggatttgagaaggaatatggcatcaaagttgtggaatccacatttacgtccaacgaagagatgcttgccaagctgacggccggagggaccggacagtatgacatgaccatcgccagcaattatgtgatcgatgccatgaaagaacaggacctgatcgagccgatccagatggatcaggtgaaaaatgtgaagtatctggacaaaagcacgctgaaccagccatttgacaagaacaatgaatacacgattccatatatgacttcatttacagtactgtgtggaaacaaaaaaaaattaaaagagctgggtgtggatatcaaaagctttaatgatctgacgaacccgaagttgaaaaataatattgtgcttgtggatgatatccgtgagatcgccgccatggcactgaaagtcaaaggatacagctccagtaccacaaaggaagatgagattatgagcacactgccgtggcttaagaagctggcgaaaaatgtgaaggtctatgatgctgatgcaccgaaaagcgtaatgatctccaatgacgtggcagtcggcctcatgtacagtatggatgcggctatggccattgaggagaataaagacctggacgtgatctatacaaaagaacccgcgcagaaatgtctggacaattttgtgatcatcaagggggcaaagcatgccaaagaggcaaggctgtttatcgattatgttttacggcctgaaaactacaaaaaagttctggatgagtactatggtgtatgtatcaataacggcacaaagaagctgctggatgaccactatctgaaaaatcccggtgcaaatgtcgatcagaaagagttaaaaagggcagaatatattgatgatgtaaaggattcggcgagcatctatgacgatctgtatacgaaattaaagacagagtaatatatgggaggaatgagtatgaaagcgatgaaacgtctggatattatcatccgtccggaaaaactggagaagttaaaagagatactggaaaagaaagactattcgggcatgactgtattcacggcaatgggatgcggataccaggaaggctttatccctgaatttgaggaaatgaattttgagatcaatctgctgccgaaggttgtcgtgatggttgtcgtgtgggaagaagacgtggaggatctgctgggggcgatccatgaggaactggccaccggacaggtgggagacggaagggtctttatatccccggtggacgatgtgatgcgcatccgcaccggagaacggggcgctgaaactttgtagaagggtggtggaaacttcgttgaaaaatatcatcgtacgcttaagaaacatagaaaaaatttacggaggaaaatctgtcattgatcatctgaatcttaatgtggcccggggtgaatttttgacgctcctcggtccgtcaggctgcggaaaaacgactacgcttcgaatgatcggaggttttgaagatacggacggcggacaaatttttctggaagataaagatgtggcgggcaaagcgccgaatcaccgggatgtgaacacggtgtttcagagctatgcgctgtttcctcacatgaacgtttttgacaatgtggcttttggccttgtggaaaaaaaggtgccgaaagcggagatcaaaaaacgggttgatgagatgattgaattggtgcagcttcagggtatggaaaaaagaatgccatctcagatgtcagggggacagaaacagagagtcgccatcgccagagcgctggtgaaccggccaaaggtgcttcttctggatgagccgctgggagctctggatctaaaattgagaaagcagatgcagtttgaactgaaagaactgcagaaaaagctgaagatcacgttcatttacgtgacccacgatcaggaagaagcactgaccatgagcgaccggatcgcggttatgaatgagggaaggatcgaacagctggggactccggtcgagatctacaatcaccctaagacaaaatttgtagctgattttatcggggagtccaatatttttgaagcctacattgaggaaaagaagggaaacaggatttctctcgtgatggagtccgggaaagtggaacttgacgctccggattttgaatacgatgagatggtctatgtatgtgtacggccggaaaatatgaaagcgtccatggaacccagggatggatttaccctgagagggactgtgatggaacatatttttgttggttccactataaagaccatcatagaactgcccagcagccagctggtcaagatgacaaatcctccggaagatgaagtgatcccggtgggtaccaacgtataccttcactggcttccccaaaaaactgtggtcatgcacacgcgggaagaccgggtctatgagattatagagggggccggaaatgaaaaagaagagcaataaaattccgtttctgtcaaccgtatcgccggccatcatctggcttattttgttcctggtgctgcctcttctgtatatcgttggtatcagtttcatgaaaaaagggctttatgggggcgtgatccagacctttgatctgacagcctataagacgatgtttcagtcgaagtatatgaagattcttttagattcgctgtggctgtcactgaagactaccgggctctgcctgctgttcggctatccgtttgcctatattatttcaaatacaaagaaaaaatggaaaccgttttgtgtcctgctgatcatgctgcccttctggatcaattctctgatccgtacttacggatggaacagtatcctgcgcgagcaggggatattaaatacactcctgatgcagctggggatcataaaccagccgcttcagatgctctacacagacggggcagtcctgctgggtatggtgtatgcgctgatcccgtttacagtgctgccgctgtattcttccattgaaaagcttgatcattcccttttggaggcggccagcgatctgggggcatccaaggtacatgtgttccgaaaagtcatacttcctctcacgatgcccgggatttttgcggcatcggttcagaccttcattccgtctttggggtacttctttatcacggatatgatgggaggggccaccacgatgaacattggaaatgtgatcaagaaccaattcctgactgcgagaaactggcctctcggagcggcgcttgcgattgcactcatcgcagtgacgatcgttatcatgaagctgtatacacgggtcggaagtatagaagatatggtataggaggaatgagcaatgaaaaagaaaaagattggattccgccctttggcactgtgctatgcatgtcttttctatctgtttttatatttgccgatcgcggtggtcgttgcattttcctttaacacatcccagctcaatgtgacctttcagggctttacatttgagtggtatggaaggatgtttgaaaatgtccagctgatgcagtcgtttttcaacactctgatcgtagcggccgtcagcaccctgctctccgtgattcttgggacactgtgtgccgtgggcatgtaccggtttaaattcagaggacgggaaactgtcagcaatctgctgtatattcctattgtgatcccggagatcgtgctcggtattgcggtgctggcattttttacgatggtgaaaatacagatgagtatggctaccctgatcatttctcatgtgacattttccatgccttttgtagtcatcacagtgcggtcaaggcttgcgggcttcgacccttccgtggaggaggcggcaagagacctcggggcaaatgactggagaatttttcgcagggttacgctgccgatgatcctgccgggggttttatccggagccatgctggcgcttacgatgtccctggatgacgtagtagtcagctttttcacaaccggaccggacagcatgacacttccgatcaagatcctcggaatggtgagaaaaggagtgtcgccggacgtaaatgcactctcgacgctgatgatccttggaacggtcctcattatgctggccgcaacattttttgagatgagaatggaaaagaaagaagaagcttgacacggagctttatatgacgtactattttgttgagaacaattatcaaaatggagcgaaagatgagattaacagagacaaatccaggtaatcagtatctggtggaagaaatccagctggaacttgcaacgaaacgccgtcttgaatctctcggcatgacggaaggttctaaaattaacgtgatgcggaagaagcgcaacggggctgtgatcattaagatcagagggacccgatttgctctcggaagagagattgttatggggatcaaggtcagggaccgtgcaggaaagagggatttatcatgagtgcagaggaattgcaggtcggattcgtgggaaatccgaactgcggaaagactacgttatttaacgcctataccggggccaagcttaaagtggcaaactggcctggtgtcacggtggaaaagaaagaaggggctttaaaataccacaatcacatgtacaggctggtggatctccccggcatttacagcctgacatcctatacgatggaagaaaagctttccagggaatatattcttcaggatgatgtggatgtcatcgttgatgtggcagatgcatctgcgctggaacgcaatctttatttgactttatgcctgattgagcttggaaagcctgtgattctggctttaaatatgatggatattgtcaaggagcggggaatggagctggaccttcaccgtctgccggaggtgctggggattccggtggtgccggtttcagcccggaaaaagaccggactggaagtgctcatgcatgcggtagctcatcacaaggtggagggaaatgaccgccaggtctttgactatccggacaggatcgaggaaaagattacacagatcaggctgcggctgaaggagaaatatccggatatgcccaacagccggtggtatgccataaaacttctcgaacaggacgaggaagttacacaaaagtacggaactctcgtgaaagggatcgtggacaggtcctacgagaatgatattatcaatgaaaaatatcactttatcgaacgggttatggctgaagttctggtcaacaaagaaaagaaggaagcgtttaccgataagatcgacaatgtcctgacgcatccggtcctgggaattcctatctttcttggcattatggccgtggtatttttcctgacatttacggtcggagatttcttaaaaggatatgtcgagatgatgatcgactatgtcagcgggtacataataggcggacttgaaagtctgggagcgggagcgtgggtgatctccctcatgaaggacggagtatttgccggagtgggaggtgtactttcttttgtaccgaatatctttattctgtttttgagtctgggacttctggaggacagcggatatatgtccagagtcgcatttgtcatggacagcgtcatggacagactgggtctctccggaagggcgtttatcccgatgcttctgggattcggatgcagtgtgccggcagtcatggcatcaagggctctggaagatgaaagggaccggaagaggacgattatgctgatcccgtttatgtcatgcagcgcaaagcttcctatttaccttgtgttttcccagctgttttttggaaaagccgccatgttagtggcttattccatgtatatcctggggctggttctggggatttttgtggcgtttgtccacagtaagatgctcaaaggcagtgtaaaacagccgcttctgatcgaactgccggaatataagacgccaaataagcggacgattgccatctatgtgtggagcaagctgaaagatttcctctcaaaggcgggaacgacgatctgtgccgcatccatcgtcatgtgggtgctgctcaatctgaatcatacagggctggtcagcgacatgagtcagagttttggtgcttctttcggaaaatttttagtgcctctgctggccccggcaggtcttggactctggcagatcgcagtcatgctgatttcagggctggccgccaaggaagtggtggcatcaagctttatggtcctgtttcaggtatcatcgtcttcggacgcaaacattgtgcacatgctgtccggaatgggcttcacttcgctgaatgcttactgcctgctggtgttctgccttctgtatacaccttgtcttgcaaccgtcatgaccataagaaaagagacagggtccacccggtggacgctggggctggtcgctttccagatggtctttgcgtgggccgtggctgtaattatctaccaggtgggaagttttcttattccataggaaagttctgcgaccttctctgtgaaataaaaacgctccgcgggttgtgcacagatgcgtaagaatatccttttcaatggcttggaattgtattaaaataaatacaaataaggaagccagctatgattggaggcatacaacaatgatcccctggtggagaaggagatctccgcggtacttttaaacagcatttacggggagtggaatggctgaaagaaaacagcagggagttcaccgatcctgtactgatccttcacggggccaacgacggactggtcagcgaaaaagactacagagagttttttggagatatcgctctgaggacaagacattaaagatatatgcaaaactttttcatgaaatctacaatgaagtggagaaagaagaagtcatcgacgacacgctgctgtggattgaaaaacatttataattaataagatgaaaaagatcttttgtttaatgcaaagggtctttttttattaatgatctgagcagttttttcgttgaaaacatatgtttggatgtgctataatctcaacagtgagtaaaaggagagatgagaatgaattccagggtgatttttcatattgatgtcaattctgcctatctcagctgggaggcggtctatgggatttctgtacggaaagatgaggtggatctgagggaagtaccgtccatcattggcggagatgagtctaagcgccgcgggatcgtactggcggcctccatacccgccaagaaaaagggaatacgcacagcggagactgtccgtgaagcattgaacaaatgtccggatcttattattcgtcctccctgtcacgggctatatgaaaagttctccgaagcttttttaaaagaggcgctggagttttcaccggttcttgagaaattcagtatcgatgaggtgtttttggatatgaccgagacggcggggcagtacgagagtccttatgaggcggcctgtctgctgaaagaccgtatttatgaaaagcttggttttacggtcaatatcggcgtggcgccgaataaactgctggccaagatggcatccgattttgagaagccaaataaagtgcataccttgtttcaggaagaaataccggcaaaaatgtggcccctgcctgtggagaatttgttttctgtcggtcctgccacaaaaaagaagcttcacaacctgggcattcggaccattggtgaactggcacatatgaatccggaactgttgaggtcccatataggaaataagcacggcatgctgatctatgaatatgccaacggcattgacagggctcccgttgaagccggacaggcggacagcaaggggtacggcaacagtgttactttaccctcagatgttgattctttagaggagtcggatgtggttttattatctttggcagagtctgttgcctccaggctcagggcggaccgcgttaagacttcatgcatcacggtggagatcaaagactgtcatttccgacggagttcccatcagagaaaactttctgtgcccacggatatcactgatgagattgtccaggcggcaaagaaactgtacagagaatgctttcggggtgtttctgttcgtctgatcgggctgcgggctacagacatatcaagtgtagaattctcacagatggatctcttcggtgatcagaaaaaagagaaactccgcagactggatcagtccatcgatgccatcaggaacaggtatggaagagacgcggtgcagcgggccacgtttcttggcggaaaaacagattaatttatattaagatggtttttcagagaaagacagctgtctgacgataaaagacagctgatttagaagaaatttcacaaaattattacaaaagtattaaaaataatacttgcttcttagaacaaaccttgatatacttcgaattgtggggaaaaatgcgcaaagaatcggagggaaacagggaatgaagattctgaacttgaaacgcatcgtatgtacactgatgtgctgcgttatgttgggcatgctatttcaggtgacaaatgtaccggcggcagagggagacaaaaaagaacttaatgtagtttattataatcaggcggattatcccggtaagaaaatcgggaagagcacgatcaaggctgcaggctgcgggccgacctgcattgcagtctgttacagttcactgacggggaagaaagtcagtgtgccgaagatgtgcaaaatagcctataaaaagggctggtatatcaacggacagggatgtgtccatcaggtgattccggggcttgcaaaagaatacggactggactgcaaaggtctgggcaccgactatcatgctataaaaaaggctttgaaaaacggacatccggtggttgctctggtaggccccggagatttcacaaaaaacggacattttatcgttttgaccaggatggtcggaaaagataaggtgagggttgccgatgtgggcagccgtgccaatacagccgagacatggtcgttaaagaaggtcgtaagccaggggaaagaaggcgcggatgccggtggtcctttctgggagatcagctatacagaaccggaaaagcaagtacaggaaaaaggaattgaccacggtctgctgaagatagggaataaaatcgatctgaaaaaacatatagaaaattagaagtataaaagcagatgctgttaagaactacggcatctgctttttttctggaacagacaaggtaaaggtgataagatatatctacagggcatactgtattctacgagtttttctccattatctccagtcggctctggaaaggcctccttctgacaatggagaaaaactatcgcaggtggcaactttgatttctaagcagcctgctccaggagataatatgtccattttctacacgattggagtgaggcattctaagagccgaacggaaatcgtgtggaaaatgtcatactatttaatgtaactttcacataagatgacaagaaaaggaggacataatatgtggtggacgagagctgaattaaaagagagggcaaaagaatcaatcaggagaaactactggattatggtggtggtagcgctgatcgcaggtattatcaatggacaaattgggggaaatgtatcttacaacagtttaaaaaccgaactgagggattccggatggaatggggaaaacatggatttctttacgagcactcaatttctgatgattgtgtcggcagcgattggaattcttatgattctttttataggatttacgctgcttaaaatctttctgggcaatcctcttctggtaggatgcagccgtttctttttggaaaacagtgacagaaaggctagatttgggttgataggaactgtttttcagagtggaaactatctgaatgttgtgctgacaatgtttctgagaaagttgtttacagcgctgtggagtctactgctgctgataccgggacttgtaaagtcttattcctattcaatgattccgtatatactggcggaaaatccttcgatttcaaggagaagagcttttgagataagcagaaagatgatggacggacagaagctgaacgctttctttttggatttatcttttatcggatggtggattctctctagtattacctgcggggttttggatgtgttttatgtgatgccttaccggcaggcaacatgggcagagttttataaagttaatcgccaacaggcgcttcagaacgagactgctacaccggaagaattgcagggctttccattttattaatatttcacgaaagataaaacaaaaaaagtgagaaaaacatgtcgatttagagaatataaatagtttttataatagtttataaaatttattgttaaaaacgtataaaaataattaacaaataatttgttttgtggtacaattaatccaacgacatacactgttacaacatactattttaggaggtatagacatgtcaacaaaatgggtttatcaatttaacgagggcaatgcagaaatgagaaacctcttgggcggcaaaggagcaaacctggcagagatgacaggacttggtcttccaattcctcaggggttcacggtaacgacagaagcatgtaccaattactatgactgcggcgaaaacatcagtgatgaggtacagggacagattttcgatgcgatgaaagcattggaaaatattcaggggaaggagttcggagacttagaagacccgctgttggtttctgtacgttccggggccagagtatctatgcctggtatgatggacacgattttgaacctaggtctgaatgacgtagctgtggaaggatttgcaaagaagaccggcaacccacggtttgcttatgattcttaccgcagatttatccagatgttcgcagatgttgtaaaagaagtggacaaagctaaatttgaagcggtccttgacgagatgaaggaagccaagggagcgaagtttgatacagatttaacggcagatgacctgaaagaagtcatcgtgcgatacaaagagatttataagagcgagttaggggaagatttcccgcaggagccgaaagaacagttgttggaagcgatcaaggctgtgttccgttcgtgggataatcctcgtgctatctattacagaagaatgaacgacatccctggagactggggtactgcagtaaacgtgcagaccatggtattcggaaatatgggagatacatcaggaaccggtgtagcatttacaagaaatccatccaccggtgaaaaacagatctatggagaatacctcatcaatgcacagggagaggacgtggtagcaggtgtgcgtactccgcagccgatcaccagactgaaagaagaccttccggactgctatgaacaattcatgcagattgccaaaactctggaagaccattaccgcgatatgcaggatatggagtttaccattcaggaaggcaaactttacttcttacagaccagaaatggaaagagaactgcaccggcagcactccgtattgcctgtgagctcgtagatgaaggcatgatcacaaaagaggaagccgtttcaaggattgaggcaaaagcattggatcagctcttacatccgcgctttgacccggaagccatcaaagctgctgtcccaatcggggaagcactcccggcatcaccaggagctgcaaccggtaaggtttactttactgctgagactgcaaaacttcatcatgaagcgggagagaaagttatccttgtccgcttagagacatcaccggaagatatcgaaggtatgcatgcggctgaaggcatcctgacagcccgcggaggcatgacatcccatgcggccgttgttgcccgcggtatgggtacagcctgtgtagcaggatgcggtgatattcagttagacgaagaaaaaggactgttcaccctgggcggaaagactgtccgtgagggagattatatttccatcgacggatctaccggtaaagtttactatggagagatccgcacgatacctgcaaccatcagcggaaactttgaccgcattatgacatgggcagatgagatccgtacattaaaggtacgcaccaacgccgacacaccggcagatgcactgaacgcagttaagttcggggcagagggaatcggactttgtcgtacagagcatatgttctttgacgcagagagaattccgaagatccgccgtatgatcttatcaaggaccaaagaggcgagagagatcgctctgaatcagctgattccatatcagaagaaagacttcaaagaactgtacgaggttatggaaggaaaaccggttactatccgtttcttagatccgcctctgcatgagttcctgccaaccacactggaagagatttcagcactggctaaagacatgaatgtgacagtagaagagatcaatatgacacgtgcatctttgcatgagtttaatcctatgatgggacaccgcggatgccgtctggctgtcacctatccggaaatcgccaagatgcagacaagagccgttatggaagctgctatcgaagtaaaacaggaaaaaggattcgacattgttcctgagatcatgattcctctggtaggagagaagaaagagctccagtttgtcaagaatgttgttgtagaaacagcagagaaggtaaaagcttattatgagtcagatatcaattatcacattggtacaatgattgaaatacctcgtgctgctcttctggccaatgaaatcgcagaagaagcagagttcttctctttcggtaccaatgacctgacacagatgaccttcggattctcacgtgatgacgcaggtaagttcctggaagcttactacgacaacaagatctacgagtcagatccgtttgcgaaactggatcaggacggagtcggacagctgatcgccatggcagctgaaaagggcagatcaacccgtccggatatcaaacttggtatctgcggagagcacggaggagatcctgcatccgttgagttctgtcataaagttggattaaactatgtatcatgcagcccataccgtgtgccgatcgcaagacttgcagcagcacaggcggcgctgaacgataaatagaactgaatcatcagataaaaataaaaattccttgagcaaacgctcaaggaattttttttcgtgtccattgaggacggtctggatgaagaggactgggaaggctggaaacatatgaccagagagcttggagacaagattcagctggcaggagacgatctgtttgtaacaaatacggagcgtcttaaaaaaggtacgaaagaaaaatgcggaaattctatcctgattaagctaaaccagatcgggacaatatccgagacgctggaggctgttaaagtggcacacaaggcaggatataccgctgtagtatcccaccgctcgggtgagacggaagacacgaccatagctgaccttgccgtagcattaaataccggacagattaaaaccggtgcgccaagcagaagtgaaagggtggcaattttaaatgaagagtatcatggaaagcagaaagaacatgtcttttaaggtgatttctttctgcttttttgtgcataaaaccttgttttttcggaaagtttaagcagtaagaacagaacctggaataaagcaaacaaaattaaggaggacaataaaatgtcattaataggtcaggaagtaacagattttaaagtacagtcttatcagggaaacgaatttaaagaggtatcaaaggaagatatccttggaaaatggtccgtgttctttttctatccggcagattttacatttgtatgcccaactgaattggaagacttggcgaataaatatgaagactttaaaaaagcgggatgtgagatctattctgtgtcatgtgatacacattttgtgcacaaggcatggcatgatgtgtctaagacaattcagaagatccagtatccgatgctggcagacccgaccggagtgctcgcaagagattttgatgtgatgatcgaagaaagcggactggcagagaggggaagcttcattgtgaatccggaaggcaagatcgtggcttatgaagtcattgccggtaatgtcggaaggaatgcggaagagctttttagaagagtacaggcatcccagttcgtagcagaacacggagatgaggtttgtcctgcaaaatggcagccgggagcagaaactttaaaaccgagtcttgatctggtaggtttgatctaagcacagatgtaaatggaaggtgatactttgaacggaattgatatgagtaaactctatgacggcatcattataggcggaggcccggcagggctttccgccgccatttatctcgcaagggcaaaatatcgtgtgctggtcatagaaaaagaaaagatgggcggtcagatcacaatcacgtcggaggtcgtcaattatccgggggttcctgaaactgacggtagaaggctcacagaaaatatgagacagcaggccgagttttttggtgcggaatttatgatggcagatgtaaaggagctgaatccggatggagacgtcaaaaaggttgtcacagacaaggggagctttgagaccctggggattgtgctggccaccggtgccagtcccagaaagatcgggtttgagggagaaatcaaataccagggacggggtgttgcttactgcgccacatgcgacggagaattttttacggggctggatgtgtttgtcttaggcggaggctttgccgcggcggaagagtctgtattccttacaaagtacgcaaaaaaagtcacggtcatcgtcagggaagaggactttacctgtgcggcagccgtagcagaacaggtcaaaaaccatcctgggatcgaagtacactatcagaccgagatcgtagaggcaggaggcgaaagcacccttcagtatgccgtgttccgaaacaatgagaccggggaaacatggagatacgagccgccgacaggaaaaagttttggtatctttgtctttgccggatatgcaccggctacggggctttttaaagaatttctggaactgaatgaggacggttatctggtgacggatatgaaccagaaaacaagcaaagacggtatttatggcgccggggatatctgtgtgaaaaacttgaggcaggtagtgactgccgtctctgacggggcagtggccgccacctcactggaaaaatatttatccggaatgtacgaaaaactgcagcttcccgagcgtgagatatccacaccggaaagaaggaagccgacggatgtgccgaagcaggaatctgcggaaactggcggatttctgacagaagaaatgaaacagcagctggtgccggtatttgagaggcttgagaaagacgtagtgctgaaattttacacggatgacagtccaatttcacgggaagtggaagagtttgccggagagatgaaagacctgtcgcctcatatccgatgtgaagtgaatccggaaggagcagagaagatcgaacttcctgcaatctgtatctgcagtggcgacggaacgtatctgggcactgcattccacggagttcccggaggacatgaattcaattctttcattatagcgatttataatgccgccggtcccggacaggccatcgatgagggactgctggaccgtattcggaacatccgcagagagatcaggattcagactgtcatatctctctcctgtacgatgtgcccggaactggtaatggccgtacagaggattgcactggaaaatcctaatgtcgaggcagatatttatgacatggcatatttcccttatttgaaagacaagtatcagatcatgagcgtgccgtgcatgatcgtgaatgaaaaagatgtgtatttcggaaagaaaagtgtggaagagatccttggattcctggagaattaaggaaaatacaaagagaaggcaaaatgtacaaaaaaatagagatgccaagttgtattggcatctctgttattttacgtgtttttttatggcttcaaagctctctttgctgatgacatgctcgatccggcatgcatcttctgccgcggtatctttgttaactcccagcgcggtaagccaggatgagagaagcttgtgccgctcataaatcatctccgcaatctcttttccggagtctgtgagataaatgtatccttccggcgaaacggtaatatgtccgttcaggcggagctttttcatggctacgctgacactggattttttaaaccctaactctgttgctacatccacagaccggacaacagggcgggactcgctcaagactaagattgtttctaaataattttcagcagattcatttaaactcatgaatttacctcatttctaataatatataatttttatgtaaagcattacaaagtatatcatatctcataatatacttcaaatatttggcttattgataaaaagaatcaacaagagatattgactgataacatatgttagaatatactaattactgaaagaaaatgataatcaaaaccaattaagaaagaaggagtcatgatgcctttaacaatggtaagagaagggaaggaaaatatcatctgtaaagtcggcggcaggggagaaacgaaaagatttcttgaaaaccttggatttactgttggcgggatggttactgtcgtatctgtcatcggtggaaatgtcattgtgaatgtcaaagattccagagtggcgattggcaaagatatggcaaataagattatggtgaactaaaaaggagagaaaatgaagacattaaaagaagttgcctgcggcgagactgtaaaagttaagaaattgaatggagaaggccctgtaaaacgccgtattatggatatgggaatcacaaaaggagtggatgtttttgtaagaaaggtagcccctttgggcgatccggtggaaatcacggtgcggggatatgaactgtctgtgagaaaagcggattcggaaatgattttggtggaatagctttttctttttttgtataggagttagttaaaactaatataaataagcatgaacaaacaagagtgtatggaaagaaaagaggtaaatgcagaatgtcaattaaaattgctttagctggaaaccctaacagtggtaaaacgacgctgtttaatgctttgacgggttccaatcaatttgtgggcaactggcccggtgttacggtggaaaagaaggaagggaagctaaaaggctacaaagatgtaacgattatggaccttccgggtatctattccctttccccgtatacattggaagaggttgttgccagaaactttctgatcggggaacggccggatgctatcttgaatatcgtagacggtaccaatatcgagaggaacctttatttgtccacacagctgatggagcttggtattccggtcattatggcagtcaacatgatggacgtcctggagaagagcggagaccagatacatatcaagcagctgggtgagaagctgggatgtgaagtagtagagatttctgcactgaaagggacaggaatcaaaaaagcggctgagaaagcagcagcacttgcaaataacagaaaagcagctcctccgatacatacgtttgatcctcaggtagaagaagttctgaattccgtagaatcaaagctgggcagtgagatcccggcagaacagaagcgcttctttgccatcaagatgctggagaaagatgataagattcaggaacagatgaaactggttccggatgtttctgatgacatcaagaagattgaagaggtaatggatgatgatacagaaagcattatcaccaatgaacgttatacttatatttcttccatcattgaacagtgttttacgagaaaccgaaaagaaacgatgacgacgtctgacaagatcgaccgtattgtcacaaacagatttcttgcacttccgatctttgcagcggttatgtttgttgtctattatgtttccgtcagcaccataggaacatgggcgacaaattgggtaaacgacggagtgttcggcgacggatggagcctttttggactcagtgtgccgggtattccttccgtgatcgaagccggactgaacgcagcccgatgtgccggatggctgcagggactgatccttgacggtatggttgccggtgtaggtgcggtattagggttcgtgccgcagatgctggtgctgtttattttccttgcgtttttggagtcctgtggatatatggcaagagtagcgtttatcatggaccgtattttccgcaagtttggactttccggaaaatccttcataccgatgttaatcggaagcggatgcggagtgccgggtatcatggcatcccgtactattgaaaatgaccgggaccgtaaaatgacgatcatgacaaccacattcattccgtgcggcgcaaagctgccgattatcgcactgatcgccggggcactgttccacggtgcatggtgggtggccccgagtgcttattttgtgggtatcgcagccattatctgctctggaattattttaaagaaaacaaacatgttcgcaggagatccggcgccgtttgtcatggaacttcctgcatatcatatgccgacagtgtccaatgtgctgagaagcatgtgggagcgcggatggtcctttattaagaaagccggaaccattatcctgctctccaccattttcgtatggtttactacttactttggatgggttgacggacagttcagaatgctcactaaaatggaacttgatcacagtattcttgccgcgatcggaaacggcgttgcatggatctttgctccgcttggctggggcaactggaaatcagctgtagctgctatcaccggattggtagcaaaagaaaatgttgtaggtacctttgggattctgtttggtttcgcagaagtggcagaagacggagctgagatctggggaactcttgccggaagcatgactgcggcggcagcatattccttcctcgtatttaacctgctgtgtgcaccatgctttgcagcaatgggagcaattaaaagagagatgaataacaagaaatggttctggttcgccgttggataccagacagcgcttgcatatgtggtctccctttgtgtttaccagattggaacattgatcaccacaggaacctttgggatcggtacagccgttgctttcctgctggttattggatttatctatctgctggtgaggccatacagggaaggcaagacgttaaatgttgatataaaaggagtaaccggtgtgagataatgccggaaacatgcgggtctgcactcaatgtgcagacctgcattatgaaggaggtttatatgggaacaatagcagtaggtttggccgtccttggcattgtcagtttgatagtcagaagcatggtaaaggataagaaacaggggaagtcgatccagtgcgggaatgactgcaaacattgcggtgggcactgcagtcgttgagaaatggagagttgtttcagcactacattgaggctggttgataaatattaagtttcccaaccacaaatatttaaacagtatcgcagaacctcagaaattggtggtttgcaggcgatttgaaagaaaaaacaggaaatatgaagttggttgggaaaaaacaaagggaacgttgattttatcagaaaaactggctataatgaaaaataggaatggcttaaaagcgggagataaacatcaacaagagttgtattgaaatcatcttctaagccgtaccgtgcggcgtcaatcgtgataaacatcaacaagagttgtattgaaattctataagtgttccatagtgttctacatcaaagcacgataaacatcaacaagagttgtattgaaataaaccaaagaaaaataccaaggatgggaagaaaggataaacatcaacaagagttgtattgaaattatgatccctttctgccatgttggcataaaactacgataaacatcaacaagagttgtattgaaattgtgctctcatgccgctttcgccgctgcgctaatgataaacatcaacaagagttgtattgaaatagcaaccaacaacgcgggtgcaggaaagaaaacaggataaacatcaacaagagttgtattgaaatgaatgttcttgtttgtcttccgatctttttctcttgataaacatcaacaagagttgtattgaaatcacaggtcccattgcttgttacaagggccgttgctgataaacatcaacaagggttatattggaagtaggtgtgttctttgatttcttcaggtactataccgagataaataaaaacaaacgttgtatcgttgtaacacattcattttagccagtaaacatatgctcagaagacaggagtgatttcctatcttctatttttttaccttttgtctgttcagctgcaccagtccacaagctgccttttttatgttatgataagagagcaaaacacaaaggaggaactatgagatttggttacgacatcccggattctttttggagcctgttccgttctgtaaaccgggagctttacatagaagcgctgttgaaaatcagcgaagaatatgaatataacaactattttctaagccgggaggtctgcattcaggtcttaagcgactggaatgcggacaagcgcatctggcttcagagggaagagtttgaatctgaactggatgtactggagactcccccaaaccggatactaaactggctgatcaggaccggatggctgaaaaaactggatgacttttcaacacttacgtccaatattgtgatccctgattacgctgcaatttttctcgagacttttgaacagctcgtgaatccgcagatgaaagatacggagatttatatccaaaatgtctatgcaacattgttctcatttcaaaatgataaacggatcaatcttgggatgctgaaaacagccctgatcaatacgaagaaattgaacaaggcgcttcaggatctgctccacaacatggacaagtttttcggccgcctgttgaaacagcagtcttacggcgatgtcctggcggagcatttggagggatatgtggaagaaatcgtcaagaaaaagtaccatatgctgaagaccaacgataacttttatctctacaaaatggatattaaaaaatgtcttcaggaaatgcgggaagacgcagagtggatcgagagagtccgggcaaaggcaagagcagagggcagggatgaaaaggaagatgtgcttgatattctggacgccatcgagagaggttttgacgacatcgagcaccgaatcgccaacatggacaaagaacattccaaatatgtgcgtgccacagtcacaagacttaattatatgctcagcggcgaggcagatatgaagggaatggtggtcagtcttttaaagcacctggaaatcgatgaaaagagggaagaacggctttctcaggtggcggaaaaaatgaatctgttacgtctggaagtcctgtcggaaaaatctcttttcagaagaaagaaaaggagagatttcatcagccggttagaacctgacgaagatgtgcaggagcttaccagagaagaagtattgagactcaataagattcatacacgttatagtaaaaaagagatcgaggagtttctggaaagccatatgaaagacggctccatggaaatgagagacgtcgacatcggcgacgatgaggcttttgaaaagctgatcctggcctatgactactgtaccaggaaaaacagccggtatcaggtgatcgatcgggaatataagatgctggaaaatggaaaataccgttatccggatctgttgtttgtgaggagaaagacatgattgaatactatgaacagctaagtgatgaggagagagatgatgtaaagcgtgtcattcagcttttgttccggcagacctttgtgctggaacggaaatacgaaaaaaggaccggaagatttgctttccagaaggattacaggatcttaaaccagcacctggaatttttaagggagtatttttcgattgccggactggaacttcgggataacagtcatatgggagtattttatatccagggagagactgtacttggagaaaagctgcccagactggctaccatttaccttttgattttaaagctgatctacgatgagcagatggaaactgcgtctgcaagcagctatgtgtatacgtccctgggagaaatcaatgaaaaaatcggggattttggcttgcttaaaaatctgtcctccgcgacagagatgaggaagaccatttctctattaaaaaaataccagattattgagccgatggatgtgctccaagatcttaacgaggagagtcgtatggtggtgtatccgtgcatcaatgcggttcttctcggggcggatgtacagaaattgattgaaacatttacggaggaggacgaacgtggagaagaagacggagaacaaacaggcattcaaagcactatcgaagatctgtctgaataactggcattatattgagcggaaagtgctttctttcagtgaggggatcaatttctttaccggacattccggcagcggaaaatctacggtcatcgacgcccttcagatcgttctgtacgccaacacggacggaaggggatttttcaacaaggcggcggctgatgactcggaccggagcctgatcgaatatttgagaggcatgatctcagtgggagacaataatgagggcaaatatattagaaacggaaacttttcctcaacgatcgttctggaactcgaacagattgtcaccggaacaaaggaatgcgtcggagtcgtctttgatgtggagactgctaccaacgagatttccaggctgtttttctggcataaaggaggaatccttgaaaaccgctatcgaaaagaagaacgtgccatggctacaacagaggtgagagactacataaaggaacattttccaagagaagaattttattttggttccagcaatgagcggtttcggagacagctctacgacatctacctgggaggactggatgcggagaaatttccgaggcttttcaaacgagcgatcccgtttaagatgaacattaagctggaagattttgtgagggaatacatctgcatggaacaggatatccagatcgaagatatgcaggaaagcgtgcttcaatacggcaggatgcgcaagaagatcgaggatacactgagggagatcggcagcttaaaacagataggaatcggttacgaacgtttttccaaggcagagcaggaggttcgggtctgtcagtaccggatggaaaagctcgtaatgctccagctgaaagaacagatcagagacttgcacgaaaaaatagagaaggcgggggaagacaagaaaatccaggaggagaacagaaaggaactgtccgcccagcttgcggatctcgcggaggagtatgaccgtctggtaaagcagatcgcaaacagcggctatgagaatttaaaaacagaactgcagggtgtcaatgaacttctggatcagctgcaaaaaagcaaggccgcgtggcagcagacgtccgcaggcctgagccaatgggcagaactggaggtaacaccgaaccagaccatatgggatattgaaagcttttccaagggaaatatcagtctcggggagctgcgcaggctccggcacagcttaaaggagatccgggaagaggtggaaaacgatcggcaggacgcggcctcagaactgagaaggatcaagaagagggaaaaggaaatcgatggggagctgaaagaactgaaaaaagggaacaaggcttatcccagagagctggaaaatgcccggtatgagctgcagacccggttaagctctcaattcggaacggcagtaaaggtacacattctctcagatcttctggacatgaagtcagagacatggcataaggctgtggaagggtatttaggatcgaataagctgtcactggtggtggagcctgattatgtcaaagcggccatggagatctaccgggaaatggatgaaaagcagtttttcagggcatccattctggacacggaaaagctcctaaaagaaaagatatccgtcatggatcacgcactggcagaggaattgattgccaagaagccgtatgtcagaagtttcatggacctgcttctcggaagggtgatcaaatgtcataccatcgaagaactgagaaatcagaggaccggagtgacccctgactgtctgctctacaagaattttcagttaaaacggctgaatccggcagattatacgaagcgttcctatatcggtgagagtagtgtgaaacaaaggatcagggatctgaaggaagaattgaaacagctttcagccaaaaaagaaccatttgccaagatgcttgaaaaagcagaagatattttgagactggaagccctggggcgttctgaggaagaatatatagaacagcaggaagccttaaagaaaataaaagaaaaaactgcgcttaaaaaagacctgcaggatagaatgctgaagatgaaggaagactccatcggtgaactggaagaaagacagagagagaataaaaggcttcagacacagaagcaggagctgttaaatgaagtttcaagagccgtctggaacagggaaaaacagatagaggactggcagaagctctatgtttccgcaaacagtgagctgactgaacaagagagaagttttcgttacagcgaagaattggaaaaagtttttgatgactatatgcaggggcgggtgtcgtcaagtcttgaaagccttaaaaacgggacatttagaatgatcaaacaggcggagaacggcagggaagaagcttacaggtcacttgtggaactgcgctctgaatatttgagagagtatccgaaccggaccttctcgccggccatagaggcgaatgaaccatatgaagaactgctgctgaagcttgaatgtgaccatcttgcggattatcaggagagggccagagaacaggcgaggtcagcggcagagcattttaaggacgattttatttccaagatcaggtatgccatattggaggcatatcagagaagagacgaattgaaccggattatcagccggctggacttcggaaaagataagtaccagttccgcatcacgaaaaacaaaggccctgatggtgtttactatcctatgtttatggatgaatcgcttcagatcgatccgtccaccctggatgcatccatggatcaccagatgaatctgttttccatggaacatgaaaaccgatacggagaggtcatgagtgatctgatcgatattttcataccgccggagaacgcatcgccggaagagctggaagaggccaagaggaacatggaaaaatatgcggattacaggacctatctttcttttgatatggaacagatcgtggaaggggaagaaaagctgaccatcggtctcggcaggatgatcaagaaaaattccggaggggaagggcagaatcctctctacgtagcccttcttgcgagctttgcccaggcctaccggatcaatctgtcgccaaagctaaggagaagccctacgatccggctggtagtccttgacgaggccttttccaagatggatgcggaaaaggtagccagctgcatcgaattgatccggggactcggattccaggctatcataagtgccaccaatgataagatacagaattatttggaaaacgttgacaagacctttgtctatgccaacccaaataaaaaaagtatttccatacaggaatttgaaaaacgggaatttgatcatctgatggaggaagcagaggatgaagaaggaactgcttaaaatgatcatcgacaggaccgagaagtctgcatcagactggaagaagggagcggaaggaaaccgttcctttctggtccaccaggaactttatgatcagataggaaaaacggagtttataaacggagccaaagagcttcagcgtcagggatgatgatgataaaataagactaaatcaacggaaacccagtaaatacaaggggttgagtcgatttggtcctgaaaaaaacttgcaacgaatcaacaaatttatgaaggaaaggcctaccttttataaaaaacttattcagatgaaagaaaatttccgcttttatctgagatgcttttactgtatcacgaaagtggtgatattacaatttaatagcgaaaaacaggaccgaattagctcgtaatggatgaaaatctgtttagctgattcggtcatttttattgattgaaaggtgatgaaaaaatggctagaattatttctattgtaaaccaaaaagggggaacgggaaaatccgcatgtacagctaatttagcagtaggattggcacaaaagaatatgaaagtgttgattgtagatgcagatccacagtctgatgtatccgcaggatttggatatcgtgattgtgatgaaagtaatgaaacacttacagctcttatggatacagtaatgaaagatgaagatattccttcagactgttatatcaggcatcaggcagaaggaatagacattatctgttctaacattggactggcaggtacggaagtacagttggtaaatgcaatgagcagggaatatgtattgaaacagattttatatggtatcaaggatcaatatgatgcaattatcattgattgtatgccatcattgggaatgatcacaatcaatgcactggctgcatcagatgaagtactaattccggttgaagcgtcttacctgccaatcaaaggattgcagcagttattaaaaacgatcggtaaggtccgtaagcaaatcaatccgaagctgcaagtcggtggaattctgtttacgatggtggatgctcatacgaatgatgccaggaataatatggaacttctcagaaatgtatatggaagtcaaattaatatctttgataattatattccattttccgtaagaatgaaggaggcagtcagagaaggacagagtattttctcttatgatccgaaaggcaaagctacagaagcttatcggagagtgacggaggaggtgctgaaagatgccatctaaaaaaagagcaacacccatttccttacagccgcttgatgcgttgtttggaacaagcgaagagacaaccaatggaatcagtgagatagcaataggaagccttcatccgtttccaaatcacccatttcaagtaaaagatgataagaaaatggaggaattgtctgaaagcattacacaatatggcgtgttggttcccggtattgtgcggttgagagagtccggtggttatgagcttgtagctggtcatcggcgaaaacgagcatgtgaacttgcaggattagagaaaatgccggttatcatcaaagatattacagatgacgaagcgacggtgatcatggtagattccaacattcagcgagaagagctactaatcagcgaaaaggcattcgcttataaaatgaaatatgaggcgttaaagcgtcaggggaaacggtctgatttaacttcttgccaagttggcaagaagttagcggcggaagaagtcagtcagaatacaggagatagttccagacagattcttcgatatattcatctgacagagttgatcgcagagtttttagaattggcagacgagaagaagcttccctttaatacagctgttgaagtttcctatttgagaactgaagagcagcagatattacttcagtatatgcataatcacaatatagtaccgtccatgaagcaggcaaaggaattgaaacagatttcaaaagaacggatgttgacgtattcagagattgaccagatttgcatgaatgaaagtattgaaaaagttcaggtgcagattccggcgaagaaattgaaacaatattttccagagacatatacaaagactcagatggaagaaattatatttatgcttctggcatcgtgggcagaaagagagggtaaagaatgaacaatgaagatatggcaagtagaatacaagtctatctgaaaaagatagaaaagatacgtgttaaacggataaaaagagagaaatttaaacatttgttgaaaacattaggattatcagcaggaaggaagtgaaagtatggctttaaaaattgtacgaagatatgatgcgaacggaagggagcttacggagaaagatctggaaacctttcgattggattctcctgtggttagagaaatactggcaaaccttaatcgggaggtggcggaaggaatcagacagagggagaaaaaaagatgacgattgaagatgtaattaaaaaatcaattctgccactggcatttatggtattctggttttggatgacaaaaacaattatgaaggtcagtgggcagacggattggttctggtgggtatttattgccggacttccatttggaatacataaaatgcggttgattctaattccgagaggaatggataccacagcaacacttgggatggctgcattaagtgtcattattggagcattgattggaagcatcatgattccagtgtatgtgatcagagcgatatacgtgtttatacggtatgtcattggaaaatagaatattagattgataagaggcaggcttgcgaaaataaaaatcgtaagtctgcctctttttttgtgcttaaaaacaggcaattcaggggaattcccttttgcaaatatatatattcttggaggatttttaagatgagagagcgaattgaaagtaagcatgtaacaaaggaaatcaaaagtcagatgccagtgattccggtggcaattgttaaaaaaagaggctgtacgttctgcccatattatctgggcaattatgagaaacagccacgctgtatgatgaaaacctgtgcctgggatgatgaaaatgaacgtttccatccagttcttcgtgaactgatcccattttacaaagagaagatggaaaaagcagaagaaaaattcctggcaatgaaaaagatttacacaacactgttaggaatgtttgccgatgaaatgaagcaggaagagttggaaaaagatgaatgttacggatgtgcctatggaaaatgtggaccatgtatcggtatctgttacaaatcaatgaaagcataggaggggtaagccaatgaatacaacagttatttccgggcgattagtaagaaatcccggatacaacgaagtggagaatgaaaaaggacttcataagattgccaagtttgttctggcagtcagaagaaattattccgatgaagtcagtttcattccggtaaaggcttttgcaaagaaagcagaatttgccagagattatctgatgcagggaacgaaggtcatggtggaaggcgagattgtcacaggtaattatgaagataaggatactgggaaaaagatctataccaccgaagtgtatgcaaaccggattgaattcgcaggtgcaaaaatggttgacagaccaccgtttccagaagatgcggaagggttcttagagatcccagagggtatggaagaagaaatgccgtttagatagaggaggataaaagatggtttcagtagatcaggcgtatatggtagggcatatgaaaaatgccgatggaagtatcaacaacaaaaatgtagtgctgtcagcagcatgtgaagcagcggaactgttccagtgcatgatggcagtaaatcagaaactggaggactggcagagatttaatcacaccttggagatgcatcttagaagtgtggaatgtgagaaaatccatgatatctgtcaggcagtatacggaatgaaacatccgtccaatgaactggaaggattgtatctggcaagagaggatgaacagatatgcctgctgtactatcaggtgtttgtagggatgctggaaatcaatattaattcagccgaagtgctgtacaaacagaaggaggaaacaatcaatgagtaagatggagtatatgccggtagattgtctgcaggtgccaaaggtgctgtttcagatggaaaaatacaaaaatctgtcaaatacagcaaagattctatacagcttatttctggatcgtttgaaatttgcggtgcaaaatggctgggtagatcataacgggaatctgtttgttatctatcccaaaagtgaaataaagaaagacctgaatacgactcggtatggagtagatcaggcagtacaggaactggttcaggttggtaaactggtgcgtatcattccaaacaatggaaaggcgaaccacttttatatcaatggtatttatgaaaatgagatggaggaagaatcaatgatgacattagatactatcatggcaaatatgccgctggctgaaagagaaattattatggataagatggtgaaagcatccagagatatttttgaaactattgcggatatgggatatattgatcaatatgaaacgtctttaactgcaatggaaaagcgaggataccaggatgagcttggagagatggatattgatcaaattaaggctgatggatatgagtttggtatggatcttgcatttggaattctggaggaaaatgaaaataatcctgctcgtgtgttagatatccagaaatatgtgaacagacagtatgaaagctgttcaaaaaagaagtttatgaaggtcctggaaacccttgttcatgcgatggggaatgatgaaggctttattggtgatatgtatgcttgtaacaagaaggccagaaattattatttggacgaaatgattcaatcattcaattttgtatttgatgagatgtgccatggtacaggcagtgcagcaaattgtgattttgatgtagaagagtaggaaaatattatggcagattttgaatatttcagagcagaagaatctgaccagttttctttttttcggataccaaaagctctgttcacagaaaaagagtttgcaagcctgtccacagacgcaaagctcctttatggaattctgcttgatcgaatcagcctgtccaagaaaaatggctggattgacagtgagggttatgtctatatcatttacacgatcgcagaattgcaggagctgttgcgaatgtcgcatacgacagtgacaaagcttctatatgagctggatagtgtgcatgggattggattgatcgagcggtatcggcaggggaataatcgtccctctgtcatatatgtgaaaaattttgtaaaacggagtagaggaaagccagtaagatactttgtttctggaatgccagaaactggaaatccagactgcaaagaattggaaatccggattgcaagaaactggaagtccggaacgcaaaaaaatagaagtccggactgcaagaatctggatggaagtaatactaagataaataagactgaaaagaatcatactgataagagtaagggcaatacacccgctttggaagaaaaattcagtcaatatggtagatttaaaaatgttgttctgtcggaagctgaactgcaggagttgatgacgctatttccatgggattaccagaaacggattgatcatctttctgtttatatgaaatccagtggaaaagagtatcaaaaccattttgcaacaatctgtctttgggcagaaaggaatggaaccaggataggaatggataaatatgaatttcaggaaggagaaagcctgtgatggaaaacaaagtaacagcagattatctggacgaagagggatgtcttcattgtggcacctgtggaaaaagaaaacagatgaaagtcagtctgatgggttttgagcatgtagtgtcctgtttgtgcgaatgcgaggtaaaagccaggcaggaactggatgagaagatgcagcgggaagaagaacagcggcagctttatcagagaaaatccgtcggacttcgggaaagaagattctgggaatggaaatttgaaaatgacaatggaagcaaccagaagatactaatcgccaggcagtatgtagaaaactggacagatatgaagagaaaaaatgtaggattgcttttgatgggaccggttggaaccgggaagagcttttttgcaggctgtattgcaaatgcacttttggaacagggagaacgtgtcatgatgacaaacttttccaggattttaaatgaaatgaccagctatcaggcagataagaaccagattatacaaaatcttgtggattatccgctgctgattattgatgacttgggaatagaacgaaattccgagtttgctttggagcaggtctataatgtgatagacagccgctattgtaaaatgcttccgctgatcataacaacgaatctgggactgaatgaaatgaagtccacagatttggatactgcccatcagcgtatttacagtagaatacttgaaatgtgtgttcccatctattgtggtggagaagataagagaaaagaagaagggacagaaaaactcgtacaggtgcagaacctgattaccggttaatctgtcttttttcattaaagggggtgattgccatgattacagatttggacagcagttgaatcgctgaaaggagggaaaagtcatgcaggaagaggtaactcagaaaacggtcacgttctgtattcgggctactaagattacggcagacctgttgaaaaaggttcttgttgcgtatctgcgtcatcagaagcagaaatcagtagagaagaaagcacagaaaaatcagccgaaacagggaaaggtcacggtaaaagagctggcaaaacagaatgccgggatggtcaatatcgagatcacggacaaaaatatcaagtcctttgaacggtatgccagaaaatatgggatcaattatgctctgaaaaaagacaagagcaaagagccgccggtttatctggtatttttcaagggacgtgatcaggatgccctcaatgctgctttccgtgagttttcccagaaacagattcaaaaagcgaataaaccttccattcataagcgtcttgcagcttaccgggcaatgatgccaaagaagacgaaggacaaagtaaagagccgacatcaggaacagagccgatgaagaaacaaaacggcaataatctgatgcagaagtggaagaataaagctggggtcaggctgtccgccctggataaaaagaaactggttcttacgaatcttccctatgttctgaccgctttttatgcggatcgagcatcctgcctatacaggagcagtcccggagaagatatagggaacaaactgttatatgcgatggaacatgcagatcggatttttacagggattctgttgagttttgacctgagagatctattggttggagttactgtcgcagttgttttgaaactattagtttggcagaaacagtcagatgcaaagaaacttcggaaaggaatcgagtatggttcagccagatggggaactgcagaggatatcaagccttatatgtcagatgatccctggatgaatattccgttgacagcaacagaagcactgactatggagagcagaccaaagcagccgaagtatgcgagaaataaaaatatcgtggtcatcggtggcagtggttccggaaagacacgattttttgtaaagccgtcggtcatgcagatgaattgttccatggtcattacagatccgaaaggtactctgatcgaagagtgcgggaagatgttagcaaagggaccgcctaagaaagataagaatggaaatattatgaaagataaatctggaaaagtggttcatgagccatatgtgattaaggttctgaataccatcaatttttccaaatcgcttcattacaatccatttgcttatatacggtctgaaaaagatatcctgaagctggtgacaacaatcattgtgaataccaaaggcgaaggggaaaaagcttccgaagatttttgggtgaaagcagagaaattgctgtacacagcactgattgcttttatctggtatgaaggggatgaagaggaaaagaatctgaatacccttctggatcttttgaacgaaagcgaaacccgtgaagaggatgaaacttatcagaatccggtggatatgatgttccaggaactggaagaaagagatccgcagcactttgcggtcagacagtataaaaaatataaaatggcggctggaaagacagcgaaaagtattttgatatcctgtggagccagacttgccccatttgatatcgcagaacttcgtgagatcatgtcttatgatgaaatggaactggataagatcggagacaggaaaacagccttgttcttgattatgtccgacacagatacaacctttaactttgtgattgccatgttacagtcacagcttttcaatctgctttgcgataaggcagatgatgaatatggtggaagacttccggtgcatgtgcgtgtcatcgctgatgagtttgccaacatcggacaaattcctcagtttgacaagctgatcgcaactatccgaagcagggaaatctctgcttctattattttgcagtcacagagtcagttaaaggcaatgtataaggatagtgcagataccattctgggcaactgtgatacgactttattccttggtgggaaagagaagaccacattaaaggaaatgagtgagcttctgggtaaggaaaccattgacctgtataacacttcggagacgaggagtaatcagaagtcttttggattgaattaccagaaaacaggcaaacagctgatgacagaagatgagattgcagtcatggatggaggaaaatgtatcctgcagatccgtggtgccagaccatttttctcggataaatatgatatcacgaaacacaaaaactatcggcttcttgcagatgaaaacgagaagaaccggtacaaagtagagaaagagttaaatccgcagtacacaccgaaacccgaagaagaggtggaagtgattcatgtagaactgtcggagtaaccttgggaatgaacgaaaaataatgaggaaaggaataactgacattaggtgcgccggctttttagtcggtgttttttcattcccgtaaacacttgaaagaagtcagttttggtttatgaatatatggcattttttagcagtgcaattacaactttaaaaactcttgtagtcgcaatcggcgcaggtcttggtgtgtggggtgtcgtaaaccttctggaaggatatggaaatgacaatcccggcgctaagagccagggcatcaaacagctgatggctggtgccggaatcatgctgctgggaactaccctgattccacagctggcaacattgttctcttaagaggagtggtagatgaacaccatcattgagagaattacggaagcgataaaggatatcctgatcgggcttatcaagtcatgtttggataacatgttcacgtctgtcaatgagcaggtgggaaccatagccgggcaggtgggacagacaccgcagggatggaatacagggatttttaatctgattcagaatttatcccaaacagtgattgtccccattgcgggactgatcatcacctttgtcctgtgctatgaattgatcacgatggtaacacagaaaaacaatttccatgaatttgagacttacaatattttcctctggatcttcaaagcgtatgtagctatttatctggtgacaaatacgttcaatatcacgatggcggtctttgatgttggccagcatgtggtcaacaatgccgccggggtgatatcaggaaacactgcggtggatgcaacagaagcaatttcacggattgtggatgccctggaggatatggagttaggggatttgttcctgctatccatggaaacgatgttgatcagtgttaccatgcacattctgtcaattatcattacggtaatcttgttcggaagaatgatagaaatttacctttatacttccatagcaccaattccgtttgccaccatgaccaataaggaatggggcaatatcggaaacaactatttaaaaggcttgttcgcactggcatttcagggattcttcatgatggtctgtgtgggaatttatgcagttttagtaaatgcaatgaccatatccagtgatcttcatgcagctatgttttcagtagcggcttataccgtgattcttgcattttcattattcaagaccggaagccttagcaaatctatattcaatgcccactagcgggcaggaaaggagcgcataccatggcgtatgtaccagtaccaaaagaccttaccaaggtcaaaacaaaagtagcattaaatctgacaaagcggcagctgattttcttttcacttgccgcagttgtgggaattccgttttatctgttcatgagaaaaccaatcggttccagtattgctgccattttgatggtaacgatcatgcttccgtttttcttcatggcaatgtatgaaaaagacggacttccctttgaaaaagtggtggcaaatatcattcgacagaagtttatctgtccggcagtaagaccatataagacagaaaatttttatcaggagatttccacccttgtaaaaaaggagggtgtgccggatggcaaaaaagacaaagcaggagactcagcaggagcgtctgtccctggcggaaaaaagaaaccgtcaggaaagaagaaacaaaaaaagcagaaaagaaagagaacaggaaaagcgtaagaagaaacaggaacgggaccgcaggaaacagaaaagcattcctacaactgcacagcagagtattccgtatattcggatgttgcaggatggtatctgccaggtgacaaagacctttttctccaagacgattcagttttacgacatcaattatcagcttgctttaaacgaggataagaccacgatatttgagaattactgtgatttcttaaattactttgattcttccatcagtgtgcagctgtccttcatcaatcagcaggtggatgtggcagaatttgaaaaaagcattgatattccggatcagacggatgacttcaatgccattcgtgaagagtaccgtactatgctgaaaaatcagctttccaagggaaataatggtctggtaaagacgaagtatatcacttttggaatcgaagcagagagtctgaaggtagcaagaccaagacttgaaagaatcgaaacagatatcttaaacaactttaaggttctgggagcacaggcacattccttgaatggactggaaaggcttgagattctgtatcatgtgttcaaccaggatcggatcgaaccatttaagttccagtataagatgctgccggaaaccggattaaaaaccaaagattttattgcaccgacttcctttaacttttccaagaatcagacatttttgatgggaagaacgatgggaagtgtaagttacctgcagattcttgcaccggagctgacagaccggatgcttgcagatttcctggatgtggatgacagcatcaatgtcaacattcatatccagtccattgaccagagttctgcgattaagatgatcaagagcaagatttcagatctggataagatgaagattgaagagcagaagcgggcagtacgttccggttatgatatggacgtgcttccatcggaccttgtaacctatggagaagaggcgaaaaacctgctggaagatctgcagtccagaaatgagcgaatgttccttgtgacggttctggttatgaataccgcaaagaagcggcagaagctggataataatattttccaggtgcaggggatcgcacagaaatataactgttccttaaaacagctggattatcagcaggaagcagcacttatgtcctgtattccactgggagtcaatcgaattgaaattcagagagggcttaccacatcatcaaccgcaatctttgtgccatttacgacacaggaactgtttcaggaaggggaagctctttattatggattgaatgcgttatccaataacatgatcatggttgatcggaaacgcctgaagaacccaaatggactgattcttggtacaccaggttctggtaagtcattttcagcaaagagggaaattacgaactgttttctgattacggaagacgatatcattgtctgcgatccagaagccgagtattcggcacttgtgcaggcgctgcatggacaggtggttcgggtttcaccggtatctgaccagtatatcaatccgatggatctgaacctgaattattccgaggaagacaatccgctgtcattaaaagcagattttattttatctctgtgtgagttgattgttggcggaaagaatggactggagccggtagaaaaaacgattattgaccgttgtgttcggttagtatatcaggaataccttgccaatccaataccggagaagatgccaatcctggaggacttatacaaccttctgagaaaacaggaagagccagaagcacagcgactggccacttcattggagatctatgttacaggttctttgaatgtatttaaccatcagacgaacgtggatatcaataaccgtattgtctgctttgacatcaaagaacttggcaaacagctgaaaaagattgggatgctcgtaatccaggatcaggtctggaacagggtaacgatgaaccgttctgcccataagtccaccagatactatgtggatgagttccatcttcttttgaaggaagagcagactgcagcttatagtgtggaaatctggaagagatttcgtaaatggggtggtattccaactggtatcacccagaatattaaggatttgttgtcttccagggagatagagaatatatttgaaaattcagattttatttatatgctcaaccaggcttccggtgaccggcagattcttgcaaaacagctgaatatctcaccaacccagctgtcctatgtaaccaacagtaatgagggggaaggacttctgttctatggaaatgtcattattccatttgtagacagattcccgaagaattccctctataaaatcatgacaacccgcttggaggaaacttccgaagcaggttaaatcaaaggagaagaccatgttacgagcaatttcatatgtattaacttttagtggcggtgctgtatttggcatcgcttttctctgtttattacaggcagggaaagggtatccgaagaaggaggagtaatcagtggcagaacagagaatgaaagtcagggataagaaggtccagaagatgaccaaagatggtctggtggaagaaaacctgacggataaatcttctgttcgtgtcagtaaccgtgccagtgatgtgcagatgggaataaaacagggggaaaaagcagaaaaccttgtggataagtctccccgccagtctaagcggagtgggaaaaatattcgtccctctgtgcaaaaatccagggatgcaccggaactgatgcgaacggagaaccaaagtgaggattttggacaaaatagaaagcaacaaaaccggaaaagaatccgtgctgagaacagaaaagaatcaagatttgcggaaaaatctgaagccagccagtcagggagactgaaagaaaaacgtgcggatctttcagaaaacagaggagacagccggagtaagaagaatggtggaagtaagaaaccaaagcagaaacagcgtctgaaatttgcttatgaagagactggtgcttctgtgaaaaatgacaaagatatggagaaattgaaccagatggatacggatggagtcaatttccgtcatcagaaacagaaggaaaaagccaaaaagttttcttatgaggaagcaagaaagaaaaaggaagcaaagcagcattccaagaaggcacaggtttatcaggcaaatgaaggagagggttctggaaagaagaaatcccgcctgaagtttggggaaggggaatctgtgaaaacagaaaaagcttttgttgttaagaaagcaggaagtgcaacttccgcagcattgcaccgtgagatcagtaaaaatgaagacgataatgcggcagtagaaggtgcccataagttggaagaaggatgcgaaggtatttaccggctggaacagagaagtgccagacgaaggaaacagagggcttccagaaagagaagcagactggagagacaggcagagaaacagacacaggcggcagcccgtcaggagcagaagaagctaaaaaaacagattcagaagcaacagatcaaacgggattatgccaaagcaaagcgaagtgaacagaccgtaggtacagctacaaaaggtacgattgattatatcaagaagattggcggcaaagtcaccaatttctttaaagaaaaccggaaggtgtatatcagtgtggcagttctgatcggattgatgtttctgattataacgaatgtcacgtcatgctctgcagtgtttttacaaaatgtgatcacttacacgggaaccagttatctgtcatcggatcaagcaatccgggaagcggaactgtattatacacagctggaagctaatctgcaggagcggattaacaacatggaatctgaagaaccgggacatgaggaataccgatataacatcggacctattgagcatgatccgtttatcctgatcagttatctgtcagcaaagtatgaggagtttacttttgaacaggtcaagccggaactggatgtattgtttgcagagcaatatcatctgactactgaagcagtcaatgaaactgtgacagagacagcaacagtaagagttggagaatctttgggacaggttgtaacaagcggatattgtaactgtccaatctgttgtggtatttggagtggaggaccgactgccagtggagcatatccaacagccaatcataccttagcagtagatgcttccaatccgtttgttccaatgggaacaaaggtggtcatgaatggtgtcgaatatacggtagaagataccggagctttcgcaagatacggtgtacagtttgatgtctattatgacagtcatgcggcagcatccgcacatggtcataagacctgggaatgctatctggcagatgataatggaagccaggaagtggaagtgaccaggacaagagatgtagatgtgctgaatgtcaccttaaacagcggaaatctgatgtcgatctgtcaggacaggctgggatttttccagaaagaactgttcagtgcctataacgatacgaaaggtaatttacagatgtttgcgacaccggttgattttaactggtattccagtgtgacaagttattatggatatcggattcatccaatttcaggagcaaatcagcttcataatggtatggatatcggagcgccggagggaacaaaagtaatggcagggctgaccggaacggttacaacttctgcttataacgacagctatggcaattatgttgtgatcaaggacagtaaaggctatgaactgcggtatgcacatttaagcagccggagtgtatctgcaggtgtatccgtcacgaaaggtgatgagattggtcttgtaggaaatactggaaattctacaggaagccatcttcatattgaacttctgaaaaatggagagcgcttaaacccgatcttttatctggaaactggagaaggggcaggctttggcggcaatgaatacaccagtgaagcggcacagcgtttgttgaacgaagcagcgagatatctaggaacaccgtatgtgtggggtggatattctccaagtggatttgactgttctggatttgtaagttactgcctgacaaactctggtgtaaggaatacaggaagattgactgcacagggactgtatgacatctgcacgccggtatctcagtcagaagcacagccgggagatctgatcttttttacaggcacttatgatgcaggagttccggtaacgcacattggaatctatgtaggcaatggtcagatgatccattgcggtcatccggtgcagtacacgtccatcaattcaccatactggcagagccatttctatggatttggacgatggtaagaaaaaagggcggctgcatcagccgtccggaaaggagaagcgatgaaaagtcttgaaaaagcaacggcggattatgagaaagccaaggaaaaaatggaagcatccaaagctagatatgaagcagacttaaagcggttcaaggctgcggagattgcaaaaacagaagcggaaaatctggaaattgtaagaattatccgtgcaatggatatgagtattcctgaattggaagctttcaaaaagagaatgaaaaatgaactgcccggcagggtggaaatacagaaggaggaaacaaaagccgatgatgaatctggaaaaaatgaaacagaagaagagaacaattactaaaagcagggtaaaaaagggcttgcttgcagcaacgacatttctttgcctgacaacacctttgctccagacacagactgcttatgcagctgagaataccgcacctgcgattacgattgagaaaccggatggctggaaacagggagaaacaaccattgctgttacggtagatgccagtcatatgccggaaggtttctcaatagcgaagattgaagcaaaagcaggaaaagatggaagttggcaggatgtaacaggaagcggaagtatcacgattacaggaaatcagacagtgtatgtgcgtgtgacagatggtgagggaaaggtctatgagcagaatcgctctattaagtgttatgacacggaaaaaccgacactcactgcttccctgacagatggtgtgctgacgattcaggggaatgatacagtatccgggattactgcggtaacagtcaatggcaccacttatacagacttgaaggatggaatgctgagagtgcaactgacacagaaagattttactacaaaacagattgagattacggtaacagatggtgctggaaatacttctgaaaagtatgtgttgcagaatccttactatgaatgggcaaagaagcaggcagaaaaacagaaatcttccagtgacagcaatggtgcaatggcaactacgaccagtgcagatgcgacggggactgaaaaaacaacgacttctccgcttccacaggatgcacaggcttctgagccgacagatgcaaaaggaaccgtggatgatcggacagtaacaggtattgaggaacagcttaataaagaaggcgagacggcagaatccgttaccaaaacagctacggaaggtacaaaagagttttataccatttcaacgaagagtggtaagattttctatctgattattgacaattcaaaatctcaggataatgtgtatttccttacagaagtcagtgagaaagatctgatgaacttcacactttctgattcagtgacacttccggaagtagatactgtttatgcagaaccagagaaacaggctgaagaagaaaagccggaaacggcagagacagatgagaaagataaagtagaggatgacattcagatgccagaagacaaaagttcagcagggacttatctgctgatcggattggttgcagtcggagctgcggcaggaggttattacttcaaagtctataaaccaaagcatgaatatgatgacgaggatgagatggaagaggatgaagaggaatccgaagattcagagtcagaaaaacgggaagtagacgatgcagatgagcaggaagaaagtgcagaaccggaaatcctgagagatgaagattttaatgatgatgtactggaagatgaagaagaggagcaggagtaaatgaaattagtgattgcagaaaagccatcggttgcgatggcactggcttccgtgcttggagccagaacaagaaaagatggctacgtggagggaaacggttatatcgtttcctggtgcgtaggacatctggttggattatgcgatgcatcggaatacgatgaaaaatataaaaaatggagatatgaagatctgccgattgtgccggagtgttggaaacacaaggtattggaaggcacgaaaaagcaatttggaatcttaaagaaactgatgagagattctaaagtagatgaagtgatctgtgctactgatgcaggacgtgaaggagagttaatctttcgtctggtgtatgagcaggcaggatgtaaaaagccgatgaagcggctctggatttcttccatggaagaacaggcaattaaagatggatttgcgtcattaaaagacggttcgtgttatgacagtctctatcagtcagcactttgcagggcaaaggcagactggttggtgggaatcaatgcgagccgtcttttttccgttctgtataaccagaatctgaaagtcggaagagtgcagacaccaacacttgccatgatcgtggatcgaaatcagaagatcaaggaatttaccaaagaaaaatattatatggctcatatcaagtttgatgatatggatgcagttacagagcattttcagaaaaaagaggatgcagataaagtggctgcggactgcatggagcggatgtgcgaagtggaaaaggatgatgtgaaagagaaaacagtccgccctccgaagctttatgatctgaccaccctgcagagggaagctaacagaatgtttggctataccgcacagcagacattggatgccgtgcaggagatgtatgagcagaagcttgtcacttatccgagaacagacagccagtatctgacagatgagatgggagaaagcacagaaactctgattcagatgttacttggggaaatgccttatgctgaaagcctggaatatcagccggacgtgagtaaggtattaaattcaaagaaagtatctgatcaccatgcgattatcccgaccatggaagtagcaaaggcagatataggtaaactgaaagaacgaaactgcaagattttgtacctgatcagtgccagggtactgacagcaaccgcagatccttatatttatgagagtcataaaagccagattacctgtaattatcatacgttttatctcacggcaaagaaaacaaagcaggaaggattcaaggcaatcgaaaataaaatgaaacagttctttggcgtaaagagtgagaaagaagagccggagctggatatctgggcaggcaagcattatggtccctgtgattcttttgtatcggagcattttacacagccaccgaaacagtacacagaagataccctgctttctgcgatggaacgtgcagggaatgaagaactgaccgaagatacagaaaagaaaggactaggtactccagcaacaagggcagcaatcattgaaaaactgattcagtctggttttgtgaaaagggaaaagaaaaatctggtgccgacagatgatggcaatgtgctgattacggttctgccggatgagattaaatctccgaagatgacagcagagtgggaaatggcattgaatcacattgcccagaatacagagacagcagatgaattcctaaatgggattacagagctgatgcaggaactggttgccagatatcagggtatttcagaagaaaagaaagagcagtttcagggaaaagcaaaaggagaagtcattggcaaatgtccccgttgtggagctgatgtcagggaaggaaaagtaaacttttactgttctgatcggaactgtgcttttaccttgtggaagaatgataaattccttgcaagccagggaaaaaagatggataaggcggcagcaaagaagttcctgtctaaaggaaaaatccattataaagatctggtatcaagaaaaacagggagacagtatgaagcaactgtggaaatggttgatcccggcgaggggaatgtgcagttcaatctgatttttccacaacgataagtagtgtattgcaggcagtctaaggactgtctgttttaatacaattattatgaaagagaggaccttagcatgaagaaaaaaggtaattttagaaaagtagtatctggattgctggcaggcatgacaatgcttagtacagtgttatctccgatgactgcatatgcagcggagatccagccagaggaaaaaccgccactttatgaggaagtgaaagaccttctggatgaagatgaggtggtgactgccaaagattatgaaatcgaaacaggcagtgtatttgatgtgaaatcagactacacaggactggaaatcaaggatgataacaaggtcaaagtcacattcgaggaagcaaagaacgacaaggatgaggattttacgacagatcatgcggacacttacaaagcggtctattatgtggaaccggtaaatcaggagcatccgaagtatcagatcagccgaaagctgattgtgcgtgagaaagaaacagaagtgcagacagaaactgcagggagtgaagcggtaaccgaatccgaaacagctggcagtgaacagcagacagaagaagcggaggattccgaagcagactcggagattaccgatattgatgctgatgaatttgatgatttagtagagcaggcacagaatcaggatacctatgatgaagaatcagggttagagcttcacgatgttttggaacaggcaggagacgaaggggtggatcttgattctatggaagagggagagattgcaacatttgaagcagtttcggcttattcagcaagaactacacagcaggtaacgattgaaaaaggacctctgtatagatatgcagattataatcttggaacctatctgacagagccgtactatatcagctacggaagcgtcagagcaactgcgtattgtgtacagccagcaaaaccaggaccaggatctggaaattatacaatcacaaagatcggggacaatcaggcgttagcaaaagtgtgttattacggtacagatgccgcagggagcgaaagtttttttgcgaataaacacacggatttctcagaaggaaaaagatttatcattattcacatggctgcatcgtatgccaatggaagcagtgatgcattctatggaacaaatgctacaggcgaggctttggcaaaagaactctataattattgtgtgaataagccggaaataccagatgtagcgatgtcattttcaaaaccgaatgtaaaagcttatgtagatggaaatgttcagagaacggagaacattaagttcaatgcatcttcccagcagaaaattacaatggacttaccaaagggtgtaaagctctataatgtatctactggaaatgtaagtgcggcaggtgcaagcgtaacaattggaggaggaactacgttttatctttcagcacctctgacacagacaaaagatgtaagtgctactttttctgcaaaaatgaagggtagtattacaaaagattattcagcatataaactgactacgaatgcaagtgttcaggatctggcatttgtgtttggagaaggtgtcgctgatgaaaaatatgtaagcttaaaggtgtcctggattgaacaggctacgatcgaaatcgtaaagaaagacgatacagcggatgtcaatcttgcaggtgcagtattcggtgtatacagcgatgaggcttgtacaaagctgatcactcagatgccggcaacagataagaatggaaaatcttctgttacgatcatcaagacacaggataccgtttatctgaaagagatcacagcaccacagggatatgtagtaaatgcaacggcaacaaatgtaaaactggtagcaagtaagacttcctctgtgactgtagaaaataaagaacagcttgcagagcttaccatttacaaagaaggacaagttcttaccggagcagatgtcagtgaaaatggaacggtattccagtatgaaaaccgcagacagaaaaatgcagtgtataacgtgtatgccggggcagatatcgtaactgcttatggcacaaaagtgtacagcaaaggtgacctggtaaaagataatctgactacgggagagaatggttctgttacactgaagaatctgcatcttggaagctatgtggtgaaagaagcaaaagcaccggacaatttctataacggcagcgaagaaaagccagtgactctgacttatgccggacagaataaagaagttgtatttgcagatgtgacttttaacaacgaaagacagaaagcagatgtttccgtagtaaaacaggataaagatacaaagaaaccactgaatggcggtatttttgctctgtatgcatccgatgatattagaaatgcagacggaaccgttgttgtgaaaaaaggaacactgattgagaaagcaactactggagcagatggaacagcaaaattcacagcagatcttccgattggatattcctattccgtaaaagaagatcaggcgccggaaggctatgtaagaaatacagaagatgtgtatacgttcaagttttcttacaccaatgataaagaagcaaccgtatcatttgcccataccttcagcaatgaccgtgtgacagcaaagatcaatttattcaaagttgataaagaaacaggaaaagcagtaccacagggagatgccacactgaaaggtgcagtttatggtctgtatgcccgtgaagatatcgtgcatccggacggagcaaccggaactatttataaagcaggagaacaggtagcatctcttacaacagatgacaaaggacagtcttctgtaaaaggtttatatcttggaaaatattatgtcaaagagatcacaccgccgaccggatacctggcagatacagaagagcatgatcttgtgtgcagttatgaaggagatatgacagcagaagtaaaaagagagtgcacttccagtgagcaggtcatcaaacagccatttcagatcatcaaggcagccaacaatggaaagaccgatgcagatctgttatccggagccggatttacagtttatctgaaatcttctcttacaaagaaagcagatggaagctatgattttgattctgccaaaccagtagtgagtggagaaaatggagcaactgagattttcacagatgaaaaagggtatgcctgcagtattccattaccatttggaagctatatcgtgcgtgaaactacaacaccgcacaattacaagccagtcgatgattttgaagtgaatatcacagaacatcatccaaacgagccacagatctggagagtgcttctggatgaagagtttaaggcaaaactgaaaatcgtgaaaaaagacgatgaaacaaagaaatctgtattgattgccggaacagaatttaaggtatatgacctggacaacaagaagtatgtggagcaggtaacaacttacccagtgacaactactcacaagtcctattttacggacagccagggatatctgatcatgccgaagaatctgaagatcggacattaccggattgaggaagtcaacgcaccggaagggtacacaatcaataagaactatgtagagattgcggtggatgcaaacacagcataccagatggattctgagagcggagatgccattattacggtagactacgagaaccatccggtaaaaggaaaactgacgatctataaaaaaggtgagatgctgaccggatttaaaaaggattttgtttatgaagaaagatacctgaagggtgcatcatttcatgtctatgcagctgaaaatatctatacaccggattatcagaaagatgaaaacagaaacagacagctgatctatgcaaaagatgcactggtaacaacggtaacgaccggggaagacggaaaagcagttgctgataacctgccgcttggttcttactatgtggtagaaaagactgcaccggaaggatttgtcctgaaccatgacagatcggatgtctcatttgtctatgcggatcaggatacacctgtgatcgaacaggaagtgacggttggcgatgaccgccagaaagttgcaatccaggtagaaaaacaggatgcagaaaatggtgcaaccgtagcgggagctgtctttggtatctataacaaggcggatattaaggcggatggaaaagtaatcgtgaaagcagacacactcttacaggaaatgacttctgataacgatggtcttgcagcatgtacgctggatctgccacttggacagtattatgtgaaggagttaaaagcaccggcgggatttgtatcctctgatgaagttctgaatctggatgcttcttaccaggggcaggatgtgaagacagtaaaactgaaaacagtgaaaaagaaccagccgacaacagttgaaatcacaaaatctgatgtaacaacaggtgtggaactggatggggcaaaactcaccgttcttgataaagaaggaaatgttgtggatcagtggacttctgtaaaagatcagccacatgtgatcaaacgactgactgtgggtgaagaatacacccttcgagaggaaatggcaccgtatggatatctgaaaacgacggatgtgaagttcacactggaagatactgccgagattcagaaagtagagatgaaagatgaagttccaacaggacttctgatcatcaacaaaaatggagagtttctggataaggtgacacttttggatcatgtaaaaggtaccgtggagcatctttttgagtatgtaaccggaagcctttcagatgtgactttcgatgtatttgctgcggaagatatcaaagcggcagatggtgtcagtgaagattatttcaaagcagatgaaaaagtaggaaccattaccacagattccaatggtattgcacagatgggagatctcccggctggaaaatactatgtgaaggaagtaaaaacagcccacggttatgtgctggacaaagagccgagatatgttgacctttcctaccgtgatcaggacacaccagtcatcacttatgatgagaaatggcagaatgcccgtcagaaagtaaaggttacggttctgaagaaagaaaaagatacagaacgtgttcttgcaggtggtgtctttggtctttataccagtgaagatatcaaaaatgcaaagggcgaggtactccttgagaaaggcagtctgatcgagcagagggtaacggatgaaaaaggacagattacttttacggcagatcttccggtagatggaaaatactatgtgaaagagatctttgcgccggacggatttgttacaacagaagaaatacaggaatttacctttgaatatgccggagaagaccaggcagaagtaagctacgactttacttttgagaatcagccaaccacagtggagctgaccaaaacagacctgacaacaggtaaagaacttccaggtgcacacctgaaagtgacggattcagatggcaatgcagtggatgaatggacttctacggaagaaccccatgtgatcaaagaactggttgttggtaaggaatacaccatgacagagacaaaaccggcagatggatatgtcactgcagaaagtattacctttacagtagaaaatacagccgagattcagaaagtagagatgaaagatgatgtgacaaaagtgcagatcagtaagacggatatcacaggagaaactgagattccaggtgcgaaactgacgattctcgataaggatgatcaggtagtagagagctggacttccacagaggaagcacactatatcgaaaaacttccaatcggtaaatataccttacgtgaagagcaggcaccgaaaggatatcttctgacatcggatgttagttttgaagtaaaggatactggagagatccagaaagtagctatgaaagatgacactgccaagggaaaagtgattctcaataagacagataaatcatcaggagaaccgctgaaaggggtagaatttgaacttcgtgacagcaaaggaaaagttctggaaaccttaaagacagatgctgccggtcatgcagaaagtaagctgtatgagattgccacatttaagaacggcaaatatgataccgctatcaagtattatctggtggaaacaaagacactggacggatacacactggatcagaccaagcatgaagtgacatttgcctatgcagatgacagtacaccggttgtagaagttacctttaatctgacaaatgagaaaccggaagttccagaaacaccgaacacaccacaatcccatgaagagacaaaggtatcaaacgcaccgaaaacaggtgacagcacgaatatctggctgccgatcctgcttcttgtaatctccacaggaggtatggcaggactgtatatcagcaggaaaaggaaaagcaaataaggaaactaaaaccaacggttatgattgggagcttctatgtgaggctccctttttcatacaaaaatatcacagaaaggaacagaaaactatgatgaaagcaatggaaaaaagacgggaagcacgaaaaaaccaggagaaaactttaaagagaatgatggcttatcagaagaaatccgagcagatggtcagcagaaaaagaatgaaccatcacatgatcagaaaggggtaaaagcgtatgatgaacagaaaagaattttatgaatatgtcaaagacaatgtaaaggagtatctgccagagtcttataaggatgcagaaattaaactgcaggaagtagaaaaaaacaatggtttgaagctgacaggtattacgattccgaatggagatcagagaatcgtaccgacagtctatctggattccctctaccaggaatatatccatggaaaagatgtagactcttgtgttggcgatgtggctgatatgcgtattgaggcacagggaaaagcagaattttttgatatgggagttccagatattctggattatgaaaagatgaaggacaaattacagatgagaatttgtgataaggaatggaataccgatcttcttgcagataaagtagtcacagaacacggagattttgcagcttattatgcagtaaatctggaggaaaatggagaagggatcagcagtattccggtaactgtttctctgatgaacgagtggggagtatctgccgaacagattcaagcggatgcgatggtggcagaccgaaaacgtggtgtcacacttatggatatgaatgagattatcaaatctatgatttttggtgaagaaccagaaaacctgctgaatgaaaaaatggatatggaagccatggaaaacccaatgttctgtctgacaaacaaagctaagatgaatggagcttccctgttactgcaggaagatattcgtaaacagattggggaatgcctgggaagtgattactttgtcatcccatcttccattcatgaagtgctgattcttcctgataacggcatttttcaggttccggaattaaatgcgatggtacaggaagtcaatgagacaaaggtggagagacaggagcagctttccgataaagttcagttttgtgatgggaaaacggcagttatggaaaatgctgagcgtagggaagctcgtttggagaaagaaaaagcagccgaaaaagcggaagtaaaaggtggaatccatggaagactggagaaagctaaggcagaaatcaaggcaaaagagggagacaaagtgccaaagaataagtcaaaagagcttgccacagcattataaagagtaacaacgatgattttaaggggactgtgctaagcagtccctgattttatgaaaaggagtagcgcatggcaaataaattatatgcaatggaacagctgacggaagaggtggcaaaagatgtagctgccagtccgcaggaatggatgcggttcctaaacactgcatccagactgtacaaatacacttttccagaacagcttttaatttatgcacagcgaccggaagcaactgccgtagcatccatggaaatctggaatcagaagatgtaccgctggatcaaaaagggatccaaagggattgccttgattgacaatacttccggaccgaaaacgaaacttcggtatgtatttgatgtgcaggacacttataaagtgcggaatcttggaaaggatcctcagttatggaatcttccggtggaaggagaacagctggtggcagattatctgcaggagcagttatcactggaagatacagaaggaggacttgctgaaagtctgcatcaggcagcgaaggagagtatgcaagaatggcttccagatgcattggaagaactgagactggacgtaacagggacatttctggaagaactggacgaacagaatcaggaagtcgaatttcgggaactgatgaccaatagtgtctggtatgtattactaaaccggtgtggactggatgcacaggaatatctggatgcagaggattttcggcatattacggactttaatcagctgatagtattaggacatctgggaagtgcagtcaatgagatcagcagaccagtcctgatgcagattggacgatatgtgctgaataatctggaaaatgacctgaaaacggttgcaaaagaaaaagaagtagtctataatgaatttaacacgttaatgcgtgaaagtaatacagataacacagaagatagagaagaaaaaaaggaggaaacagactatgagagagatcagttacagccagaacggagagtatcagattccagatatcagcctggaagagacgagaggaaccatcggcaagtacggaatgatgcggaaagagtatctgagaaatcacaaggtagccaggttcaacattctgacactgcagaaccgtctggacagtcatctgatggagatcgacagccaggcaagacagagagtagacgacctgatgaacgaacttctggagaaagatccggcaccggacaaaatggcagacgggatggcatggaccagacacatgaaccagatcaaggcacaggcagaggagctggtgattcaggagattatttacagttaagtctgttcccaacagaagaggaacagttaggagaaataaggaaagcggcagctgcattggaacagccagccgcttttcttatttccgatgaagtggtaaatgatattctccgcacgggaagcggacagaaaaatacactgtttcatattacagcaagactgattgaaggtctggataatgaagaaatgcggagttttctgaaagatgaatatggaactggtggcaaaggatttaccatagatggtcagaaaatcagtatctggtatgacaatgatggtatccgtatccggcgaggggactctgccagaagaaactttgaccgcatggttacgtgggaagaagcagcgaacagaattcgggatatgtatgaggatggaaattacgtggataatttgatttccaataatgccattgaacaggagcaggaagaaatgaccaatcttcttgcacttcattttcgggatacttgcagaaactgggaaaagaaacaatcatattcagactggcaggatgtagtgagtggagcatggacagatcaagaggaagcagatgcgattgtctatcgttttgaatggctgcagaaatatatggatgagaatccgggagattatcaccgctgggagattcagcataatccggaatatttccaacgctttcaggatcttcagagggagcgttcctgggtagaccagaaatttacggtcgaacgtccggcactatcctttatcacacaggatgaaattgacgcagtgttaagaagaggcggcattactgcaggaggacgtaaccgaatctatgagtatttcatggaacatcatgatatgaaagatgcagctgagttcctgaaaaatgagtatggaacaggtggttcctcacccggaataccaggagcagatgcttccgatgcatcccatgatgcaaaaggattaaaacttgcaaaagggaaaattggcagtccagaggtagaagttttattaaagtggaacaaggttgcagaacgtgttcgccagttaatccgcacagatgattatttgtcaccggaagaaatggaaaagtacgaagaacgacaggaagcacaaagactggcagacctggaagaagcacagcagatgttaggagaacagctggaacaggatacttttacagcggaagatataacggatctgcgactagttgattcagaatatatgtccggtaccagaacaaaaatctatgattttgcttgcaaagttaagggagaagagaatcgacttcaatacacattagaatatcatgatgatggagaaggtttcacgattcatacggaaaaagatgatatttgggagcgaatgtcaacacaagaattggaacgtctggatgtaaaacttggacaagaagtactttattatcattatcacaacaaaacagtaaatgcggataccttagataaattacgggaaatcaaggaagaaatcatggaggaagagtcttcctattttactgctatttctaaacgtgtgtggacagattatgataaaaaagaaaaagaactgtcgggagaagttgaggtattggaagaaaaagaatcattggaagagattaacggaatagcagaactgattccagcaacgaacttccatatcacagatgatgaacttggacagggaacaccgaaggagaaattccgagccaatattatggctattcagctgttaaaaaaatgtgaggatgagaaccgcaatgcgacaccagaggaacaggaaatcttatccaggtacgtcggctggggaggtcttgcagatgcatttgatgagacaaaatctgcatgggagacagaatatttggaattaaagaccgtccttacaccggaagaatatgctgcagccagagcttccacattaaatgctcattatacacagccgattgtgattgaaagtatgtatcaggtgttggagaatctgggatttacaaagggaaatatcctggagccatctatgggagtcgggaacttctttggaaagcttccagagaatctaaaccagtccaaactctatggagtggaactggacagcatcagtggcagaattgctaaacttctctatccagatgccaatatccagatcaaaggctttgagaagacggattatcccaatgatttctttgacgtggcaatcggaaatgtgccattcggtgcatataaggtcaatgaccgtcagtatgaccgctacaattttatgattcatgattactttcttgccaagactatagatcagttacgtccaggtggtgtagctgcgttgatcacaacaaagggaactatggacaaggaatcaccggaagtccggaaatatttggcagagcgtgcagacctgctgggggctatccgactgccgaacacagcttttaaggcaaatgcaggaacagaagtcagtgctgatattttgtttttccagaagcgtgagagtttcacaaaagtgatgccagactgggtgaatttggagagtgatgcaaatgggattaccattaacaagtattttgttcagcatccgggattgattcttggtgagatgaaagaagtgtccggtccgtatggtatggaaacaacctgtgctccaatggaaggagctgatctggaattacagttacaagaagttgtaaaacacatcagaggaagcatggtagcggcagtagatatagaggcagaactggatgagatgccagagagtattccggcagatccgaatgtccgaaattacagctatacggtggtagatgatcaggtatattaccgtgtcaattctttgatgaatcaggtgaaaatgcctgcagtcactgcagaacgtgtaaaaggcatggttgcaatccgtgataccgttcgtgaactgatcgccatgcagatggaagaatttgtcacagacgaagaaatccagaaacagcagaaaaaactgaatcaggtgtatgatacctacacagcaaagtatggagttattggaagtaatgctaacaaacgtgcattttctgatgactcttcttattgtctgctgtgttccctggaagacttgaatgaagatggaacattgaagcggaaagcggacatgttcaccaaacgaaccattaaaaaggcggtcgctgtgacaagtgtggagacagccacagaagcacttgctctgtccctaaatgaaaaggctaaagtagatcttccatatatggcacagttgaccggaaagaccgaagagaaaatcacagaagagctggttggagttatcttcaaaaatccactgacagaccagtgggaaagcggagatgaatatctgtctggaaacgtcagagataaattaaatacagcgagaacttttgcagagaatcatccggaattcacaccgaatgtgcgtgcattggaggcagttcagccaagagatctggaagcgtcggagattgaagtgcgtattggagccacctggattgaaccttcggattatcaggattttatggtggaactgcttcatacgccgaggtatcttgcacagaaggaaatacaggtaaaattctctgaggtaaatggtgagtggaggattacaggaaagaacgccgacagtccaagaaatgcgtttgcttatgcaacgtatggaacggagagagcaaatgcctaccggattctggaagataccttgaatctaaaagatgttagaatctatgataaagtcgtaaatgacaatggggatgaagtgcgagttttgaataaaaaagaaactatgttggcatcacaaaagcaggatgccttgaaggctgcattccaagattggatttttaaggatcagcagaggagagaaaggctggtaagcgtgtacaatgagcgtttcaatagtatccgtccccgtgaatatgatggtagtcacttgagttttccaggaatgaatccggaaatagagcttcgtccgcatcagaaaaatgcagtcgcacatcagttatacggtgataatgtgcttctggcacatgtagtaggagctgggaagacttacgaaatggtagcggcggcaatggagagcaaacgtctgggattatcacaaaagaatctctttgttgtgccaaaccatttgacagagcagtggggagcggagttcctgcagttatatccaggagcaaatattttggtagcaaccaagaaagactttgaaccggcaaaccgaaagaagttctgtgccagaatcgctatgggaaattacgatgctgttattattggtcattcccagtttgagcgtattccaatctctgatgagaaacaggaagccatgcttcagaggcagattgatgatctggaaatggcaatccagagtgcaaggtatgaacaggatggtggacgttataccgtcaaacagattgaaaagacaagaaaaacattgcagacaaggctggagaaactgaatcagaaagagaaaaaagatcaggtagttacgtttgaagaactgggagtggatcatttatatgtagatgaagcacacagttataaaaacgcatttctttatacaaaaatgagaaatgtagccgggattgcacagaatgaagcacagaagtcggcggatatgtttaataaatgtcagtatctggatgagattaccggaggaaaaggcattacctttgctacgggcacaccgattagcaacagcatgacggaattatatgttatgcagaggtatctgcagaacagcaaattacaaaatatgggacttggactgtttgattcctgggcctccacctttggcgaggtagtcacgagcattgagcttgcaccagaaggaacaggctaccgtgcaaagtcaagatttgcaagattttataatattccggaactgatgaatatgtttaaggagattgcagatatcaagacttccgatcagttaaagcttcctgtgccagaggcggaatatgaaacagtggtgctgaaaccaacggaacagcagaaagaaatcgtagaaagtctgggggaacgtgcagaagttgtcagaaacggaggggtagatgcttcggttgataatatgctgaaaattaccaatgatggaagaaaattggcattggatcagcgtttggtgaacgaattattgccagataatccagaaagcaaaatatcagtctgtgcagagaaaagttatgagatctggaaagacacggcagcacagaaatctgcacaattgattttctgtgacttgagcacaccgaaaggtgatggcagtttcaatgtttatgatgacttgaagcagaaactgatagcgaaaggtgtaccggaaaaagagattgcttttattcatgatgcaaatacagaagcaaagaagacggagctgtttggaaaagtgaaatccgggcaggttcgttttttgattggctcaacagcaaagatgggtgccgggaccaacgtgcaggaccgtctgattgcgttgcaccatctggatattggctggaaaccatctgatttggaacagagggaagggcgtattatccgtcagggaaatcataataaaaaggttcatatcttccggtatgtaactgaatccacatttgacagctacatgtggcagttggttgagaacaagcagaaattcatttctcagattatgaccagcaaagcacctgtgcgaagctgtgaagatgtggacgaagcggcactttcctatgcagaggtcaaagctcttgcaaccggaaatccagcagtaaaagagaagatggcattggatgttgatgtggcaaaattaaaacttttaaaagccaaccacatgaataaccagtaccgcctggaagatgatattgcaaggaattttccacaacagattgcaaaactgacagaaatcattgacagctacaaggcagacatcgctcattactcagagcataaaatcacagatccagagcagtttactatggagattggcggcaaagagttcacagaaaagaaagaggcaggagcagcacttctggcggtatgtaaagatattaaagctgtagatgctgcgatggatatcggaaactatcagggattcaatatgaggattcagtttgatggatggagtaaagaatttattctatctgtcaaacatgaggctgtctcgaaagttcatcttggagcagatgcacttggaaatattactcgtatcaacaatctgttggacagttatccagagaagctttcagaagcacaacaaagactggaaacagtatatgaacagcttgcaaatgcaaaagaagaggttggaaagccatttccaaaagaagaggagttgaaccagaaactggagcgactgtcagaattaaatgcattgctcaatatggatgaacgggaagatgcagaaacagaggtgtctgaatcagatgagaaagaagaaagaccgacacgtggttctatccatgaaaaactgcagatttataaagaaaagagtcagcgggaaagtgaaactggcaaggaaaacagaaaacgggacttcggtctggaataaataaacaggaaagatggcataatttggtagaagaaggttctgcctgttatgccattttttagaacacaggaggaatttgaatggcgagaagtatgataacaggaaaagaaacgcagaaaatgcaggaatatacgcaggaacggattgctcaggcagagcgtagagatatagaattttcaacagatgtaaaagaacagatttttgaatatgcgaatctgatcggcgaggaagagaaagttaggaatttggtaagaaatctggcagatgcagtgagtcaggcagatcaagaaggtgtagaggatttgctggatgacgcaagaatggatattcaagaactgctggatccaaccataggtaagctggaattacgtgactatggatatacagcagaagatatggtgccacttagaaaagaagcagccttggattatcacagaatgggttctaagatttattgccttggaagtgatggcagtaaaggtgaatatgcgagtaaagaaatgatacaggcacacgacggtttgtttggaatggaattgcagatgtgggaacggataaaggataacaacctagatcatgcagaagaaaatttaggagcatttcaggagcctatgagtgtcattgagcaggaagaagcactgaaattatacgatgcaggagcagatatctatctgatcactaatttttcatcaccgatgtatgtcacagaacgtatggaaattgaacgaggaccagagcattatcagatgtctatgacagaactggagcgtttccgtaacctggaatgggaaatgcagaaatatccacagattcagtcattgaaagaagcaaacctgttgttaggaacaagaagggtatttggtatttatcagatccgggatgattcaccgggcgaaaactatgcttttatgaatatgagttttattgaaagtcatggtatgaagataaaaaaagaagattacaagctggtctatgttggtgaattatcaggaaatatgtcactggatgatatttttgaaaggttcaacattgatagaccggaagatttccgtgggcattccctgtctgtcagtgatatcgtagttctgaatgacggggaaaaagtaactgctcattttgtagacagtatcagttttgaacagctagattctttcctgaatctggaagaacaggtccttagtgaactggcatatgaggtaggagaacgttactttgctattcagagaacagaagaaggatatgattattccttttacgatgaagatttccgcttgatggatggtggcgtttatgagaatgatgaaatttctattcaagaagcggcggaggaacttttggaagacgaaggctggactggagaacgcatccgtggagattatgatcggttgatggagaaagtagaagaaatggatgaagttgtaatggcagagattcagaaaagccagggcgaatataagccattggcaaaggtggaggaactggaagaggccaattataacatgattgataatgtactcaataatatgccgcctaagaaagaagcttatctggaatattatgctgcagaatgtgatgaaattcatgatatgggagcttatgagaaaagcacagatgtgaaagaaatcgcagcaatctatgagaagtacagagaagatccggaaaacgcttataaaggcagtggaatggggattatttatcgtgatccggaggatagcttgtttgatgaaacagaactgttaattgtaatgggaacaacgatacacggcgacttcttggataatgtgcggtttttaaaagatcagccggtggtgcgtgaaggtttggagaagattcataaagcattgcctgattataaatatatcccgattcaggatgtgcgtgaggcaatgtatccgaaaaaaatgacaacagaagaactggcagcagcattggatgagattgcggaagacttcgatccgtatgactatcgggaccatgtagagccagggcaggataccatacaggaagtcatgctggatctgcaaagtggaaatgttggttcttatatttcctttctgaaggatgtgattgaagaagactgtgagcagtccgtgtgggcaggtgttttgctggaacggctgaaatcctacgaaccagatatatccaaagaaacagagccgatggtgtatgtgaattactgtgaaaagcgagagctgatggaaccacgctgtcagaagctctcagatttggattcccgtactgcacagaaggataaggaatggtacgcagaccgtaatccgaggacggatgagccgatggtaacagcccagatgttttttactatatattatgcggaaaaaggcgataaaatgatgcaacatttcaaagggaaaatagatattggaacaggaaatggcggtattttaagtcagctgaaactccaaaatgaactgaaacttacggatgaaagctggattggttatctgaaaaacaagggaaatgaagagtttcagaagtgtatggaagatctgaccgatatgcagaaccatgtgctgccatatttgcagagcttttgcagtctggaagaaaaaagtgtgcaggaaaagcaggaacggcaggttgcagaaaagcaggacagcagagtagaagcgtcaagagcagcgaatgtgacaaaaggggataatgacaaagctgtgaaaaaggtagtttcgagtatgcaaacagaaaagaataaagcaactacgaaggcaaagaagccatctattcatgaacgactggaaatcaataagagaaaaatccaagaaaagcagggaaaagatgagctggagagaggagctgatcgggatgtaagaacggtataaatttatagaaaggcacttggctccgttttggacatagcaaaagtgctgacagtgacgaacgaagatgtgctgcctgcttatttgcagagagtatctgattttgaagactgcctacttgcaacttgtacgaaggagaatcagtgtgatgcgattgtgacaaggaataaaaaggattttctttccttttggattacactgctttctccggaagaactgctgaatatttattcgtaaaaatatgtttttacaatcggcagcagaaggaaagttgaatgataactccgatccagcatactgcaaaatataaaaattttataacaaagtggaaaaccctgcgtaggatcagaaatgttctcacagggtttcatgtatctaataaaatatagaaatttagcggatttctgctagaataagaaaaactgttaaaaaaatatcgtgcatagatcaaaaagactatatatgggcgaccttttaaagccgatttatataaaatagaagaaaaaaaggtggtcgataccgtggatataaaaacagcggtcatatatcggttaaacgatctgattaagcagaaagatatcacagtgaatgaagcggcggtgcgctcaggcgtcccgccttcaacactgaaaaatattttgtatggacaaagcaggaatgctggcgtagttacaattaaaaagatatgcgatggattggatattacaatacaggaattttttgaagatcccatctttgcagatttggaaccggagttataggaacaggcaaataatcttaggattcagattctgcaagatggtttttttatgggaaagggttagaagaaactaacactggaggatgaatatgtgtaaaatagcaatttgcgacgatgataaagaatacagggagaaaataaagacggtcatagaaacggaagggattctgtcttcgaatgagatacggttttatgaatatgaatcaggaaaagaattattggaagatgcggatattttgcatgatctgatttttatggatatgcgtatgcctggattggatggaaataaaacagtactgaagctgagggaatataatgaagcagcgatattggtgttctgctccggctgttttgaaccgactcctgacagcattaatgttggacaaccgttccggtacatcatgaaggatctgcatgacagaagtctgaaaaaggaaatacctatgattttattaaaagtgaaattgtgctgtggagattcttccgtgacagttacatcggcgggaaggataatgcgcatccatacggaagacattttatatatctgtctggcgaaaaggggctgtacgatatacattgccagacagggaaagatagaagagatgcattgcaaggaatctttaagtgatctgtatgagtgtctggccggaaggggatttgagtatgcacacaacagctatattgtgaatttggcaaaagtggaaggattggaaaagaacgttgcgttgctgccgtttggaatccagttgaatgtttcgaggtcgagaaaaggacagtttgccgacgcactgataacatttcttggggaaaggaacggcatggtatgataataagagattatttgatttgtcttcttcagatgtatctgttggaggacttggaaaagaacatactcccatacagaagagaaagattctgggaaaaatttctcgtatattgtatcgcagcactggcaatgttcggaaccaaccgcctggaatcctcaatacttaatatggtaatgattccggtaatctatatgattgcgtctatggttgtgttccggggaaatatatggaagaagctggttacggtatgctgctattatgtgctggcaattattcccgaatttctctttgcggcacttacgaatgcatatggcgtgactggtgcgtccgagggcttcaggactgaaacagaaaagacattagcactcctgctgatgagtaccatgacatttctgtttattaaatgcattaatcaggtaacaaggaaaagggattatctgacgattgagaataaaacttttactgtgctgctcatgctgccaaccgctacgatcattatattaggatgtgtgttttattcaaatatttcttttgaaggaatgaacagggttatggttccggtaggagcttcgcttctgttaatgacgaatatcttcattttcacagtatttgacaggtttgtagaaaaatcagaagaagtgaagaagatggaccggctataccagaaaagcagggcggagattgctaatttacagtatatgaataaggtcaatgaggataacagggcattcttacacgatataaataaatttatttgtacagtagccggtttgatggaagaaggagaaaatcaagaggttaaggagattatggaacatttaggtgtccggattcagagccttcaaaaaggtgtgtattgcgaacacccgatcttgaacagcatcctgtgcgaaaggaaattccttgcggaatctaagaatatttcctataagattaccctgggtaatgatctcaggctggactttctggaagaactggatatgatctcaatcgtaggtaatcttttggataacgcactggaagcggcagaaaagacaaaagatggccgatatgtggaatgcaggatgtatatgggaaatgaggaacatttccttgttatggaattttgcaacgggtatgttgttccactgttaaaggacaaggaccggtacataagcaccaaaagagatgcagacagtcacgggatcggactgcatacggttggaaaactggttaaaaagtatgctggaattatgagagtggaggtcggagaacaggagttctctgttaagctgatctttacaataaaataaagatgtgcaaaaatcgcccaaaaagttaccgtttttgccacggtaattgaaaaaagggcgatttttgtgtaaactatcggaaaaaaatggaggcatgtaactatgaaaaaaacaatcagaaaaagcttgggtatcaaagtacttggagttgtaaactgtcttgcactctgcctgacggcatatacggcaaatctggcgtgcaactggctgtactatcaggaagaagagccggaagaagttaagaaaatgaggaaattctagtgtggaaaaaaactaccggctggctttttgaagtgcaaaacaggaacgggattcttgaagagaaagaccgcaggctgtatgaatatgcttacggcgtactgctgggcagggtggcgatataccttatcattgtcatacttggcattgtaacggggaattggctggagatgctagtctttttattgccctttactgttctaaggcagtatgccggagggattcatttagaaaaagcagggagctgcatggttgtttccagtatccttgtccttctgtgcggtcagtatctggcgtctggttcggctgtgatgtggcaaatacggatcatatggcttgctgcagttggagtcatatttgttatggcaccggtggatgccagcagtaagaaactggatgagaaagaaaagaaagtttatggtatgcgcgcgagggcaattttaattattgaatgcgcgatagcaggtgttttttctgtaaccggatatttcctggtcgtaaacgggattatggtagcgcatattgttttggcgtccggtttaatattgggatggatcaaaaattttttttgacaaagagttagagttaactaatcctggataggaataagaaatgcttgggaaaagcatatcacaaaatgataataaacagaataaaaaagaacatgatgcaagaggaacataaaagtgaatttgaagttgataaaaaatacagaaaatattaacaaagagaaaataactttgttttgtctgccgtttgcggggggcggcgcttctgcttataaccagtgggcgaaaaagatgcagggaaaagtaacggtatgtctggttcagcttccgggaagggaagaacggatcatggagaagccgtatatagatatgccggttatgttagatgatctggaagaggcagtaagagaggttgtggatggaccgtatgccttatgggggcacagtatgggcggtaagattgcctatgagctggaaaagagattggaagcggtcggatatacagcgagctgtctgtttatttccggtagccggattcccagtattccggagccgaagccgatctatcatcttccggatgaagagtttaagagggaactgggaagatttgaggggacgccaaaagagatactggagaatcaggaattattggatttctttctgcctatgctacgggcagattttaccatggatgaaacatattatgacaagacgggaatagtactgcatgcgcctatcgctgcatttggcggagaaaaggatggcgaagcggatgagagcgcaatctgcgaatggggaaagtatacggataatgattttagctaccggatatttccgggaggacatttttatttgcgggattacgaagacgaagtaataagtgaagttataaggcgcctgccgggaataaaagatggagattaaacggtatggagcgaaggaatttctggcggcaggcaaactttgtatccgtgaaaatgagatacatatatggtgcatctgctggccggaaatgacagatttctgggtgaaccatgaatatatcctgagtgagcaggaatcggagcaggtcggaagattccgcttttcggaagacaggatgcgttatatagccgggaaggttgtcgtgcggcttctcttgaaaagatatttagatgtggaaacgattgatttttctgtcagtgaacggggcaagccttatcataaaaagattgcaggaaagcagaccgtagattttaatatttcgcattcgggagaattcatactggcgggattcgctgttggaatggacatcggagtggatgtgcaggaaatggcgggatgtccggattactgggagatagccgggaatttttatacggaagaagaagcggaagatgtaataaaggaaggatcgactttgtttttccagtactgggcggccaaagaagcgtatgtaaaagcgctcggtattggattaggaagaggaatggatttcttctctgtcagaaacggggaaattatagaaaaaggcaggaatgatcagggctggttcctgtatccggtcaggatcaaaggatatgctgcgtatgtggcggtgcataagaaaggagatgaatcaaatgggttataagaaagatatgagcaaatatgagtatctggaaggttgggagagatgtagttttggagaacagcttgataagtgggcggaaaaatatggagaaagaactgcggtcacggacagcgaagacgagatcagttatatggaattaaagcaaaaagcagattgtcttgcggcagcttttctgcgtaaagggattttaaagggagacaaagtgcttgtacagcttccgaacaggatttcttttgtggtcgtgttttttgcgctttccaagatcggggcggtgccgatcttgatgctgccggcccacagggaggcggaactggaaggaattattgaactggcaaagccggccgcttatattgtggcggagaaatatttgggattttcatatgtgccgatggcaaatgcgatgaaaaagaaatattcatatatccggcatatatttgtagatagcgaatccggggatatcagtggaatgattgcggaaacgtgtggagaaaatagagcatttccggctgtggatgggtatgaaacggcggttcttttgctgtccggcgggacgacaggggttccgaaactgattccgcgcacccatacggattatatgtataatgcccgtatgtccgcgaaaagatgccgcctggatagcagcgacgtttatctgacgtctcttccggtagcccataattttccgttatgctgcccggggcttttaggtacgctggatgtgggaggaaaagttgtgcttgcgtctgcgaccagcccggacgatattcttgacgcaattacagaggaaggcgttacgattaccgcattggttcctgctatggttactgtgtgcatggaaatgttggaatgggatgaagattatgacatatccagcctgcgaattttgcaggtgggcggcgcaatgctggaagattcccttgcagataagatcattgaagaatggccttgcaaactgatgcaggtatttggtacggcggaggggctgctgtcctttaccagtccggaagatgaagattccctgatcgtaagatgccagggaactccggtgtctcctgcggatgaagtgaagattgtggatgaagaggataagaccgtaccggaaggagtttttggggaattattatccagaggcccgtatacgattgatggttattatatggcggaggaagcgaataaaaagagctttacgccggacggattttatcggacgggcgataaggctatgtggacgaaagacggaagactgcgtttgggtgggaggatcaaagagcagattaaccgcgccggagaaaagatcatgccttcagagattgaagcttacctttgcaggcatctggagatcaaagaggcagccgttgtcggcgttccggatgaaacccttggaaatcggatatgcgcattccttgtaaccgatgatgaagccgggatcgatttacaggaaatccacaggtttctacgggaaataggcgttgcggcgtataaaatgccagatcaggtagaacgggttgaaacatggccgctgaccagcgtagggaaaatagataagaaagcattagaacggatggctcaggaaaagtagaaggagacagtagcatggaatatatagagataaaggaacagatcaaacaaaaactgccggtagccagagattttggagattccgaaaatctgttggagcttgggctttcatccctgacgatcatgcgtctggtaaaccagtggagaaaacagggggttaaggtttctttcggttcattgatggaaaatcccacctttgaaggctggtgggcgttaatccagagcagcatgaagaaaaaagcgggcaaaaaacgggcgcaagaatctaagataacgccggaaaaggatatgaaacagccgtttcctttaacagacgtacagtatgcatattgggttggcagggatgaagaacagtatcttggagggatagactgtcacgcatatttggagtttgatggggaaaacatagaaccggagcgtctggaaaaagcatggaatgtactgcagtatcatcatcctatgctgcgcgcctgctttttggatgatggaacacagaaaatcctggataagccgtattgtgaaaaaataaaggttcatgatttttcccggatgtcatctgaggaagcagaggcaatggcagtatctgtcagagaacgtttatcccatcggaagttaaagattgaggaaggcgaagtagcaggaatagagcttacgctttttcctgaaaataaggcacgccttcatgtggacatggcgcttctggttgctgatgtacagagtctgcagatattattgagggatttggcatctgcttaccgaggggaaaacctgccgaaagaatcaaaagggtggaattttgcttcctatctggaacggcagaaacaggaagaagaggaggaacggaaaaacgcagaaaaatactggaagaatcgtttagagcatttgccaaaaggccctgaccttccattggcaaaacgtccgcaagaagtggaaaaaacggtgttcaaccgcaggattgtgagaatcgaaaaggaagaatgggatcatttgcaaatgcgggcaaaaaaataccagacaactccggcaatggttcttcttactgtatatgcggtggttctggaacgatggagcaggaatcattgtttccttattaacattccgttttttaaccggaaaacagagcagcaggggttagaggaagtaatagcagattttactactctgttattgctggagattaactgcgaagaaaatccgacttttgcggaattgttggacaggattcagaagcagcttcatgaggatatgaagtatacggcatattccggcgtgcaagtccagagagatcttgcacagatgtatggagacgcatcggcagtggcgccggttgtttttgcctgcaatctgggaacgccgttggtaaatgatacgttccggaaagaactggggcagttttcctatatgatttcccaaacgccgcaggtgtggaatgacttccagagttatgaagatgaaaatggcgtacagcttacatgggacagcgtggataagttattcccggagaatatgatcccggatatgctggagtgttttgagaatcttctgcatgaattgggaaagaaggactggaatcagcgatttgatgtgcttcctgaaaaaagaaaaagagaaattgaagatacagcgcgtacaggagtgccggagcgtgtggaatgcctgcattgggctgttatgaaccatgcggaagtttgcccggaagatattgcgcttattgatgcgggaagcggaagatcggtttcctatggggaattaaaagcacgggcgacagcagtggcggcagggatttcagaaaaggatattaagggagtcccggttgcacttaccctgccgcgcgggatagaacagatcgaggcggcactaggaattttgctttccggaaattcataccttccggtcagcttaagccagcctaaagatcggagagcgttaatccatgagaagacgggagtccgctatgtggtcacgaatcgggaattatccgaaaaactggactggccggaaggtacggaaatccttgtgatggaaggtatggaagagggacaggaaaatgtgagactgccagaggtgtcgccgaaggacagcgcctatatcatcatgacgtcaggctctacaggtgttccgaagggtgtagagattgcgcatgaaagcgcatggaatacggttcaggatattaatgaaaagtaccatgtgacaagtgcagatcgggcgctggctgtatcagctatggattttgacctgtcggtatatgatgtttttggaattttaggcgcaggaggaacattggtattgcttccagagcaggagagaaggaatgcggattactggctggaacaagtgttgaaatatcagattaccgtttggaattcagtgccggtgcttctggatatgcttttgatacgggcggaatccatgaaacagaaactgccgatcagggcggttatgctttccggagattggattgggatggatctcccgcagagggttgcggcatggacagaggattgccagtttgtcgctatgggaggagctacagaggcaagtatctggtccaattatcagaatgttaccctgccgatgccgaaaaactggaaatctattccttatggaaagccactcagatatcaggcatatcgtgttgtggatgagtatggaagggattgcccttactgggcagaaggcgaactctggattggcggttttggtgtagcaaaaggatataggggagattctgcgcttacggggcagaaatttatcacagatcagtatggaagatggtatcggaccggcgatctcggaagaatctgggatgatgagacaattgaatttttgggaagaaaagaccatcaggtaaagattcgcggacacaggattgaattgggagaaattgaacatgtgattcaggagtttccgggtgtggctcatgcagttgttgatacagttagtgatggtcatggcaataaaacgctggctgcttatatcggagcgccgatacaggaagattctaaagttacaacgtatttgtacggcacagatatctttggcgggggctggaaagaactgaaggatgatgtcagcaattggcagatgcagcaggaacggaagacagcatacaaaaatttccttgcctatgcagaccagagatgtgtacagcttatgctggagacactcatagagttaggcatttttgtatcagagaaggaagttctttcgcagaaggaaatttttgaaaaagggagcattacggaaacacagaagaatactgtggcaagatggttggaaattttaaagaaggaaggaatcctgagagaagaggacggcagactatcgcgtaccgggaaggaagtggctgtaccggaaaaagctggagatacggaaacgtattttaataaactgaagccgcatctgaagcatatggttactgggaatgaagttccgctggacgtattctaccagaaagagccggctttggctccgaatatgctgcttcggaggattccgggctgcgaggaaacagtggaaagactggtgcagggattaaggcttctggcagaagaacgcagaaaagagccactccagattatagaaattggtacaagggacactgcaattacaagacagtttttgaatgcactggaagatgtaagcgtggcttatacttatgcggattcttcaaaatattttctgcaggaagcagagaaagaacttgcgggatatgagagagtcgagtttgagatgctgaatctggaagaaggcatggataagcagcagatgtccttgcatagttatgacgttgtgatatcggtaaatgctttacatagaaatattgatgctgcggatgcggtaaagaaagtagcggaattactgaagccaaacggaatattgctgatgactgaccttgtggtaaggacataccttcaggaacttacagcggcttttttggaaaatggttttgcggatattcgggacaagagaaaagaagcagggctggttaccccggattgcctgctgtggagagaatgtttatcagaggcaggattgggcgaagactgtgctgtgacagagagatatggaagatgtatatgctgcagcagacagcaggcgtctgtcctgtcctatcataatggagcactaagggaatatctgtcagaaaaactgccggagtatatgcttccacagaattatcatttcatggagcagctcccaacattgtccaatgggaagattaacaggaagcaattgcgggaagattttaaagaagaaactgcggttatccgattttcaaaggcaacgacagaaacagaagaaaagcttttagatatctggaaacaattatttggatatgaaaatatcggaattgaagataattattttagccttgggggagactcgctgattgccacaaggttgatctcggaagtacagaaaaccttcggctgcaaaataacgatcagcacgatttttgaaaatctgaccgtaaaatctctggcaaaagctattgaacagtccgaacagaaagaagaagatacactgcagatcaaaccgaatctggaggaagcatatcatccgttcccattaaccgatgtgcagtatgcttactggcttggcagaagcggattgtatgaattggggaatgttgcaacgcactgttattttgaactggatgcagacggccttgatactgagtgcgcagagacggcatggaatctgttgatacagaggcatgggatgatgcgtgttattatccagccggatggtatgcagcgcatactggagaatactccccagtatcatattgacgtgacggatatccgacaattggaagtgacagaaaaagaaaaggcattggatgaaaaacgggcagagatgtctcatcaggtaattcagacagatgaatggcctctgtttgatgtgcgaatcactaaaatagaggaccagaagcatagaatccatatcagttttgacaatattatctttgatggctggagtatgttccatctcttaaatgagtgggcagaagtatatcgaaatggaaaagcggaaatgccgattactttgtctttccgggattacgtgctgggactggagcagataaagtctacctctgcttatgagaaagataaaaaatattgggaagaccgggtggagacttttgcggacgcaccggatctgccgcttgcaaagaacgaaagccagattacagagcagcgtttctgtcgccggagcgcaaaactgtcacagaaagaatggcagtctgtaaaagacgcggcgggaagactggaggtaacgccttctgttcttttgatgagtgcttatgcggagactctccgcttgtggagcagtaataaggattttacacttaatctgacgcagtttgaccggaaacaattgcatccggaagtgaacaatctggttggagattttacaacactgacattgctggagataaagaatgcagggaataattttgcggaaaggacaaaggcaattcagaagcagcttacagaagatctggagcatacagcttatggcgcggttgaactggagcgcgaattaaagaaaaagactggaaatatgcggggcgctattatgccggtagtgtttaccagtggccttggcgtggagcagtggaatgaaggaaagtggcttggaaaactgaactataacatttcacagacgccgcaggtgtggctggatcatcaggtggttgaaatggatggctgtttatgcctgttttgggattccgtggacgaattattttatccgggaatgctggatgagatgttccgggcatataccggcctgcttcatacgctagcagttcatccggagatcatgcaggaaaaaacggcaagtctggtaacagcggaaatttcagaaaaacggcgtcaggcgaatgaaacggcagctgaatttgaagagaaaacgttggatggattattcttggaggcggcagacaaatttccggataaggaggcgctggtaacgtgcagcaggcggatgacttatcgggagataaaagaagaggcgttttacatttccgggcagttgaagagcatgggaataaaaaaagaagagacggtagctgtatttatggaaaaagggtgggagcaggtagttgctgtttatggaatcctgtttgccggagccgcatatcttccgatagatatccataatccgagagaacgagttgaaaagattctccgtgacagtggaacaagaatcattcttgtgcagaatcaggcgtatgatcaggataccgaatggctgcacgagtgggattgtatttctgtgtctggattaaaaaccgattctgaatacaaagcacaggagaataaggcgggagaccttgcgtatgtaatctatacgtcgggaacaaccgggatgccgaaaggagtaatgattactcaccataatgcagtgaatacaatactggatatcaatgcacgctatcagattacagaacaggatacggcgtttggaatctccaatcttcattttgacctgtctgtttatgatgtttttggcgttttaggcgcaggtgggaaattggttcttccggatccggaatatggaaaagatccagcgcattggattcactggttgaatcatgagaatattaccgtatggaacagcgtgccagcttttgtagaaatgctggcagaatatgaggaatatcaaaggcaggtaacttcacaatcgctgcggttgataatgatgagtggcgactgggttcctgtttcacttccggggagaattcgtaatctgttccagaatgttgagattgttgctcttggaggagcaacagaaggcagtatctggtctaatcatttcgagattccagaggttgtgccggaagattggaagagtattccgtatggaaaaccacttgcaaaccagaagtattatattctggatcagaatatggaagattgtccggactgggtaccagggacgctttatattgccggagacggtgttgcacagggatatttaaacgataaagaaaaaacagaggaaaaatttgttgttttagatagaaatggagaacgactgtattgtaccggggatatgggacggtactggaatgacggtaatattgaattccttggaagactggataatcaggtgaaaatcaatgggtacagggtagagttgggcgaaattgaagctgctgtatccgatattttcccagaaaataggtctgtggtaattcctattaaaaggaacaatggaattgtaataattggaatagtagaaggaaaactttattacgatgaaaaaataattaagaaaaaattagaatcgacaattcctaaatatgagataccaaagcggatttttaatataaatgagtttccacttacagataatggcaagataaatagaaaaaaattggcagaagagtatcaatacgaggaagaaaataataaggaaaaaacagaaataacaactcctttggaaaggggacttttagacgagtatgaaaatatcctgaggattcgcgtaagtgttgataaagaatttttctctattggaggagattcattaaatgcattgaaactaataaggaagataaatgaaaaatataatattgtaataacgataaaagatttgtatgaaaatgcgagtgtaagaaaattggcaaagagaattatagaaaagacggaggactataatgaaggaatattataaaagataattgcaaaataatttggaaatcggaagggtagataaaatttattgtgtttgaaaattattaaggcagggtgaaaagatggaactaaaaagtattattgaagaatgcgctaaaagaaaaatacaattatggattgaaaatgggaaattgcattttagaagtccagtcggcgttttcgatgaaaaactaaaacaaaatataaaagtaaataaagacgcaattatagaatacttaaacagaaaagagagaaaaaaaattcaatctagcgaagatcaaaaatacaagccatttccgcttacagatattcagacagcatatctgcttggaagaaatcaggggtatctttatggtggaataggttgtaaagtttatgctgagtttttaactgaatttacagatgagattatttttcgagatgctgtaaaaaaacttattgaaagacatgaaatgctaagagttcaattttcgaaagaaggcgagcaaagatttttaccatacatatttaatgcacctgtccaaatttacgatataagaggctgggagaaagaaaaaataaaacataaaatacttgccaagagggaagaaatgcaatttaaacaatatgatccagagaaggatattttgtttgatttatgtctgttcatccatgacaatgcgagcattttatgcttgtcattggatatgttaattggagattttgttagtatagatttgattattagtgatttggagaaattgtacaataatcaaaaaatggaaaagctaacactgaatttcagagattatataatatataatcagaatcagaaagaggatataaattttttaatcaaatattatgaggatgaaaaatattggctgaataaggttgatgtttttcctggaaaaccggagctgtatacaagagaggaaccggagattataaggaaaggaactttcatatgtaaagaatatacagttgatcctaaaaagtggcaatatttggtgagtaaatgtgagaaattaaattttactccgacagcattgcttttgtatttgtattgtgcaacattaaacaattggtcaagaaatagtcaatttacagttaatattacaaccctacaacgaccaagtattcatgaggatattcagagaatagtaggggattttacaacaacatcgttatttgaattcgatggaacgtttgagggaaaagtaaacgcacaagtagagaaggtacaaagcaatttatttgaaaatttagcacatgatagctttactggaatagcagttttgcgggaactaaaaagaaaaggaaaagaaaatcttttcccgtatgtttttacaagtacaatagggggcgaaagtgaagacagcacattaagtaagagacaattattatataaaataagtgaaacgcctcaggttattatagattgccaaatcagtaaacaaataaatggaatattgattaattgggatataagagatggggtatttccaaaaggattaattgatgaaatgtttgcatcattcatccagctaattaataaaagcataagcgacgaggatttttttgaaaaaaatttagaagtagggataagcgatagaacaaaagaaatacgggcaagagttaatgataccaataccccttttgatgagaaatctttagttgatggtttttttacgagatgtaggaatacaccttataatactgcgcttatttatcagaaagagaaatattcatatagcgatcttctaaaatatgtaagtgcaattcaacagcgattaatagaaaaaaatgtagaggaagaggataaaataggcattttgcttgaaaaaggtgtatggcaagttgcgtcagtggttgcggtaatgtcagttggagcagtatatgtgccaattgatattacgcaaccagctgaacggatacaacaaataatgattcaagctaatataaaattgaatatatgtgatgaacaaacatgctggaaagatgaaaaaagtatattgctaaatgcggaaatgcttaacaacgtatgggatataaaatataagtatattgatccacagtcaacggcatactgtatttttacatctggaagtacaggaattccaaaaggagtagagatgagtcatgccgcagcgatgaatacaattatggatatgtgcaagaaatttaatatttcagagaaagatagaatattcggaatttcaaatttatactttgatttatctgtatttgatatttttgcgacattttttgttggggcaacattgattttaccatcagaaacagaaaaggaaaaagtttccttttggtttaaactatgtcaggaacatggtgtaacagtgcttaatttggttccggcgcaaatggaaatgtatatggcttatttacagactaccgagtacaagctggatacattgcgcttaattttgctatcaggggattggattccagttaaattagttgaaaaaattcatcaaaaaatgccaaatgttcaatgtattagtttgggcggagctacggaagggggcatttggtccatatattatccaacggatagagtaaaaagtacggataaaaatataccttatggaattcctttatctaatcaaagattttatattttgaatgaaaagaatttgccttgccttgattatgttataggagagatttgtatagctggaaagagtcttgcgaaaggatatatgaatgatgtaactctctcagatcaaaaatttcaatttattactgaaattgaggaaagagtatataaaacgggtgatttgggtttatatagggaagatggggtaattgaatttgtaggaagaaaagatacacaagtaaaaattaatggatacagagtggagttaggcgaaatagaaaatgcattaaagagatacccgggaatagaaaatgcagtagttgtaaaaagtaatgagggtagtttaactgcttacattctaggaaataaaggcaagcaagaaaaaaaggtaatagagaaaaaaataattgatgaggagaaagaatttaaatttcaatttacaagaaaggaatttcaagaatggattgaaaaagcagataaaacagccttgatgtatatcttacgctttttggtaaatgaaaaagtatttgaggatgttgaaaagcgatactccttcgaacaaattaaaggtattttaaatgtaataccgaaatatgagcagctacttatgcgatggttgatggctttaaaagaaaacaaatatcttcatttggataaagaaggattttatattgaagagatatatagtactaatattgcagaaaaagcagaggaagagtggaaattagtagataagaagattcaatatagtgacgtattgatggagtatatacatgagtcctccatgcatctcaaagagttaattacaggagtaatgcatccgaatgagttgttgttccctcaaggaaattttgatatagcatatgctgcatataaagataatattgttaatagatctattaacagaatacttcacaacgaagtattagagattataaaacagcaaaagaaaaagaaaataagaattttggaggttggagctggagttggaggtagtagcatagaattattaagtaaaatacagtcatgtaatgtagaatattattttacagatatatctaatttctttttcaataaggcaaaagtgattttttcacaatataatgattggattcgatacaaaatctatgatattaataaatcgaattgggaacaaggatttgaaaatgagaaatttgatattatattatgtggaaatgttttgcataatgctgttgatattaaaaaaagtctcaataatctaaaagaaatgcttcataatgaaggtagtttatttattatagaagaagtaagaaaaagatatgcactgatgacatctgtggagtttgagttcgcagaagcggctgttaaatatgaggatgggcgtaaaataagtgaaagtatatttataaattttgatgagtggcaacgcattatcaaaactatggagggtaatatttttatgtcatatcctgaaaaaaacgacattttatatcctgctggacaagtattgatgggaattcaattttcgtcggaaagtgaattaaatataagagaaataaaagaatatttaaaagggaaaattcctacatatatgattccgaatagaatagttcagttaagagagttgccaatgactaataatggcaaaattgataggaaaaaattgtatttacaaaaaaacaattctaatcaaacagagaaaaaagaagaatgcattgatgacttggaaaagcgaattgagagaatatggtgtgaagttatcggttgtcagaacataggacgaaatgatgatttctattcgataggtggtgattcattactcattgcacaagcgattagtaaaatgattcaaaacttaccggaagcaaaaaactggaaatgggatgctttaatgatggagatgatgaaaaatgcaactataagaggaattgccgaaaaattacaaaataattttgtgacaaaaagtgaaaaaaaggagaatgtcccagaaatttctccatttattacgttcaaagatgcggagggagattgtaaaaaggcaagagtactttttcatgctggaacaggaacattaagttcctataaagaacttcttccatatttagcaaatatcagtgctccttgtgatctgctatgtggcttcaattttgggagttttgataaatatttggagagagatacggatagtttgatcatcgaaactgcgaaagtatatgcagacattttagaagagcatccagcagaagagtatattttaattggttattgtgttggcggatggttggctttggaaacggcaagaattctggttgagaaagggaaaaatgtaagcagagtaattacaatcagctcaagtctgtgcggtcataattatgataatgaactgcttcttgaaagggcatttggactgtctataggagcggatatagaaaaagccggatatttggggagtaatgatttgctacaaaaagcactagagacatacaaagaggaaaatggggataaaggtatatcgataggagatctatgtgcattacatggagaatatgaaattttgggcatgagttttagaaaattaaataaattatcacaagaagaaaggctaaaaaaaatatatgagaatgtttctggtgatgagaaaattgatgcggataatgtaagtatgtttaaaatgttgtttcttctgtttcgacacagtttcaaaggaatcatgcactatgaaccttcggtatatgtaggagatgtacaagcaatgtttgtggaagatgatacgaagcattttttccctgttagaaatattaccaataaaagtttgtgggaaaacattgtgttaggacaattaactgtagattatattccaggggaacatattagctgtcttaaagaaccatatgtgcgtgaagtggccaagttaataaaataaacaaaaaagagaataaagtaaatacaactatagatgtttactttattctctttgattaagattatgaattatattaaacaaagtagataggatgaaattaaatatggaaaataaattttatcgggttatagtttgtgggacaaactttggaagaatatatatagaaggtatcacaagaaaaactacaaaatgtaagttggttgggatattatcaaaagggagtcaacaatctagaaagtgtgcagaaagtaatggcgttccattatatacaaatgtttcacaaataagtagcagtgaagtagatattgtatgtgtggctgtaaaatcatctattactggtggaaaaggaacggaaattgctaaagagtgtttaaaaaaaggaataaacgtgattcaagagcaaccagttcattttacagatgcgaaggaattgtatgcaatagcaatagcgaataaatgccattattatattaataatttttattcaaagctaccgtctggtatggcagctattagatatgcaaataaaattcttcatttagcggatccgattttagtagaagcagaatgtagtatacaagtattgtatcctcttttggacattatagggaaaatgttgggagggattacaccatgtaaagtatataagacaggagaaaaaaatggaatattaacaatactggaagggagcataaacgaaattccgttgatattgaaagttgaaaatagaatggtttcgcaagactcagacaattatgcattattatttcatagaatcgtagtttttacaaaaagcggtcaattagttatggataattccataggagctgtactgtgggaaccgcgatattttatccctaagaaagataatatactagagctgtttggagacaatgagtattcaaaacaaaaagtaagtgaagtgttaaacgaagaatgccttcaatacacatatcaagacatatatgagaatatatggccggagggaatagccaatgcctttgatgaatttattactataattaaagaaaaatgtgatcgacagtttatacaataccaattgaatttatgtaagttatggaatgatattggcacatgtataggacctacacatgatatttatcccgataaatttccgccaatttgtattaaggggctttaaattaaggattatttatgtagaacatataatgataatagtaggagaaacaataaaagccatatgagaaaaaacaagtatactgtatatgaattacaagatgaaataaaaaaaatatggagcgaagaactgggaaaggatttgaaaataaatgaaaattattttctgataggaggaaatagtttaaatgcaattcggatagttggggaaataaaaaaattatttgataattccatagatataccattttcatatattttttcttatcctacagtagaaaaactaagtaatgccatatatgaaattttaaatggttgcttaaaagcagggttgacatcaaaagaattagagatggaagtaaaattggatatagatttaaaaggaaagagtgtgccaataaaaaaagaagtatgtctattgacgggagcaacaggaaatttaggaaactatctgttgaaagaaatattaaggcaaactaatatggaaatatattgcttgataagggcgaaatcaatggaagctgcacaggacagattagaaggagtattaaataaaattaatatgtcactttatgaagaagcaagagttcatatcgttttaggcgatttgggagaacctaatctgggaatggacatggatgtttatgagaaattagctgaaaaagttgattgtatttatcataatggagcaaaggtacattttttgagcgattactatgaattaaagaatataaatgtaaatggaacaaaagaaataatacggtttgcaggatataagaaaataaaagcaatattttatatttccacaatatcaattttttcaaaatttagaacaaacgataatataattatggaaaatgatgatatttctgatccgggtattttacctattggttatacacaaagtaaatgggttgcagagggactgatatggaaagcaaaagaatgtggaatccctgtaatggtttacagattggggcatgttgttggggattcggaaacaggagtatgtaatgatggagactttatttttagaataataaaaagttgtttaattctaggagtatatcctgatattaaaggaagcatagcgccgattgcgatagatgatgtcgcgaaaatcgtggtaggaatatcccaaatagaagatcaatatggcaagacatatcatgttataaatacgaaagagattagctttcaagatgctgtagatattgtagataggatagggatttgcttgcaacctttagaaaaaaacgaatggatagaaattgcgaataatagagatgatttgcctataacgttatttcttgatttttttgatgataaatattggaaacaagaaagacagatagaattttcaacagaaaacttacgctctgaattaaaaaaaatgaatctagaaattaaacccatgacatatgaacttatatataaatattatgcgtatattaagaataaagagcaatggaaagaagaaactattgaagaaggaataattgattaaagcttatgcaaaatttataggtacttttataaattataataatcagagtcacttcctataatataagaaatgactctgacttcatttgtcatgagtttctaataaaaatatttattgtgaaaaatgttagaacccgtcagttggaagtatttctctctaaatttttgcggcgcttaaattctaatggcgaagcgttgaactgcttcttaaatgccgaagaaaacttgctttgattcaaataaccaacttgttctgcaatttccgatacagataagtttgtagtagtgagtaattcagcagctcgttgcatacgaatttcacgtaaataaattgatatattttgaccataaactccgcgaaagtagttcttcaggctggtttcactgacggaaaactgtgcagccagttcccacgcaggatggtgttggcgcagatcagaagtgatgattttttccacacgttttgcaatgtctacctgtgtttctgtgaagaatgtgcaggattgggaaggtggtatttctttcagattttgaagcagtgaaaacagggcaagggtatagattttcatttgtgggattgccagcggaacagaaatatccagtaatgaccacagcttttttaagacttcttctatctcagtcgtaaccgacgcaatataagtacccccatccgggcagtaaagatctctgagtctgtggaaatcaatatcaaattcagcctctacccaggagctttgagcatttacggtatccatatccacaaaaaactcaattccttcatagattcggcggggataaacgtattgctgtctggcgaatcgttcggttaaggatatctccccatctttcacatacacaaagttcccgttattcaggatgagttcgcatcgccctgttacacagtaatttaagagtaatggtcctgtttccatggagccattatcgtgaaagtctggggctgtccaggcaggagagttcacaaaaatataagccaatgtaactcctgggaacagagggaaaaaagtcatggaacctttcccgtctctctcctttagaatgagttctgcgctaaattcgcctcgttttatagatatacctggaatttcaatgcttttcttgataatttcatctatcttcattttctaactcctgtcatttggtctgttaaccgctctgtttgagccttgcacttctattataagatcacagtcaaagtcagtcaacagaaaaactcggtgctgtttggagctaaaaagatgattggttgtagagaatcagccggtactatgctattctataaaaaaaggttagaagatgctaactggaaaatgaatgtggaggtattcatcatgaataacaagttacaagcaaaagacctcattaaccttggtctgttcacggttctttactttgtcattggctgctgtgtcgccattccgattgggtttgtcccgatctttcttcctgttctcggaagcctgtggtcgctgattaccggtatcccttttatgctgttcctcacaagggttaagaaatttggcatggttacaatcatgggtgttttgagcggtctgctgatgggacttaccggcatggggttttggggtgttcctatgggactgattttcggcctgcttggggatctcattttgaaatccggcgactataaaagcgcaaagaaaagcatccttggttatgctgtatttagcctgtggatggtaggtacatatattccgatgtattttatggtcgaggactcctgggcaagctttgccgccagcttcggggaaaaatatgccgatcgggtaatggcggttatgccgatgtggagcattatccttgtggttgccgggatttttgtctttgccattttgggcggactgcttggaaaaacgcttctgaaaaaacattttgcgaaagcgggcatcgcataatggagggggtatccttttccgccacaacggacaaaaggaaaggaatccggctcgacccgcgtacgaagttgattttgctgttgacggttactacattgatgttcagcaccagcaacgaagggattatgaattttgtaaaacctgtgttaagcctaatcccatttgtgctgatcctgtcggaacgccgtttcaaaacggcaggcaagtacctgcttttatatctcgcctgctttgcactggaacgcatagcgctgacgacattaagcgatctgctgtcctttgtggttttggcgatgacatccattatgacgcggtttgcccctggtattatgacgggggcctggctgctttcctccacctcagtcagtgagtttatcggttcgatggaacgtatgcacctgacagagaaaatcgtcatccctttgtctgttatttttcgctttttccctacgatcagcgaagaataccaggcaatcagtgatgcaatgaaaatgaggggtatccggtttggagggaaaaatccatttttgatggtggaataccgtcttgtaccgctgatggtgtctgttgtgaaaattggagatgaactttccgccgctgcactgacgcgggggcttggcgctccggtcaaacggactaacgtatgtcagattggttttcatgttcaggacatgattgcgatcctgctctgtgctatatgtttcgctctgtttttgctgggacagtatttttctttttaagggggtgagcttatgataaagattgaccatatttcattttcttatggagaagagaatgaaaataccggcggtgttcgggatattgatctaaatatagaggatggtcagtttgttgtcctttgcggtgaaagtgggtgtggaaaaactacggtcacccgcctgattaatggactgatcccacattattatgagggaaagatgacgggagaagtatgggtaaatggagccaaggtttccgaacagcccctttacgatacagctgcagttgtgggcagcgtgtttcaaaatccccggtcccagtttttcaatgtggataccaccagtgaaattacatttggctgcgaaaatcttggacagccagaaaaagacatccgggaacggttggcaaaaacggttcgggacttccggctggagaagctgatggatcgtaatatcttccacttatctggcggggagaaacaaaagattgcctgtgccggggtatccattatggaaccggatgttctcgttatggacgaaccctcatctaacctggatgcggcttccatccttgatttgagaaagattcttgcgttttggaaatcgcaggggaaaacaatcattgtatcggaacatcgactttattatcttcgcggtctagcggatcggtttatctatctggcagacgggcaggtgagtcatgattattctgcggcagaatttgagcagctcacggagcagcagcgttccgatatgggactgcgcacgtttgctttggagcgtctcctgcctccggttttaccgcagcaggaaaagaccgcccttgcgcttcgtaatttccactttgcctataaaaacgaaccggaaaccttacatatcatggattgtgaaatccctacgaaccggatcgttggaattatcgggaataacggcgccgggaaatccactttttcacgctgtttctgtggcttggagaagcgctgtggggagattgtctggaacggaaagaaataccgtccgaaagaccggctgaatacctgctatatggtcatgcaggaggtaaatcatcagcttttcaccgagtcggtccttgatgaagtgctgatcagtatggaggaagcaaaccagaagcgggcagaagaaatcctaagtcggttagatttactggattttaaggacaggcatcccatgtccctgtccggtggccagaaacaaagggttgcgattgcttcggtaatcgcttcaaaacgctcgatcctgttttttgatgaaccgaccagcggccttgattacaggcatatgaaagaggttgcaaatgtattacggcaggtcagggatgccggaatcactgtgtatgtcattacccatgacctggaactgattttagattgctgtacggacatcattcattttgaggatggttcgattattgaccagtacggaatggatgaagatggcctcagaaaaataagagaatacttcataaagggggtatctgaaaaatgaaggaagaaaagaaagcgtcgccaataagtgttttattgggatggggcaaaccgtatcacggaaaattcatcggcagtgtcgtccttgcggttttgggtgttgcttgtcagatggtgccttatttctgtgtggcgcatatcgtcacaatgatgttggacggggagcaggatttttcccgttatgtgacagcttgcatggtcgcactttgcggctacctggggaaagtgctgttttccagtctgtcaacgactatttcccatacagcggcctattacacgctgcgggatatccgggagaggctgacagggaaactggcccgcgttccgatgggaacgatcctggatactccgtccggtcagtataaaacaacgattgttgaccgggtagaagggatggaatccacgtttgcacatctcatcccggagatgaccgcaaacatcctggttccggtggtaattgtcgtgtatcttttcattatggactggcgcatggcgctgttgtcccttgttacgctggtagtcggtcttgccgtaatgtctgtcggtatgatgagttacccaaagaaatgggagggtgcggtcaaagccggaaaagatatggcgaatgccattgtggaatatatcggcgggattgaagtcgtcaaggcgttcagccagtcagccggttcctacaagaaatattcggacgccgtgaattacaatgcgaattactatgtggaatggatgcgggaaaaccagaaaaccatgagtgcctacaatgcgatccttccctcagtgctgatctgtgtgctgccctgtgggtttgccttctggctgtccgacagcctggaattatctgcgttcctctccattgtgattttctccctggggcttgtgggaccgatcatgtccgtctttacctttacggatgacctggctgtactgggaaccaatgtggaggaaatcagccagctattgaacgcggaagaactgaaccataaagatacgccagtaaatctggcagataccagtatcggactcgaccatgtttccttttcctatgatggggaaactgaggtgctgcatgatgtgagcctttccattcagccgggaaccatgaccgcccttgtaggaccgtccggttccggaaaatctaccgtggcgaagctgatcgctgggtattgggatgttacgtccggtagtattaccctgggcggccatgaactgaaggagataccgctgtctgaaattgtcgcccagatttcctatgtatcgcaggataattacctgtttaaccgcagcatccgggaaaatatccgcatgggcaggccggacgccacagatgcggaggtggagcaggcagcaaaacaaagtggctgtaacacctttatccgcaagttggatcaagggtatgataccgttgtcggcagcgccggttcccatctttccggcggtgagcgacagagaatcgccattgcccgcgccatgctgaaggacgcccctgtggtcattttggacgaggcgacagcatatatcgatccagagaatgaggcagttgtgcagaaagcaatctctgccctgacagtgggtaaaacgctgatcgtgattgcccatcgcctgtctaccattatcggtgcggacaatattgtggtggtcaaggatggaactatccatgcccggggaacgcatgataagttactggaaacctgtcccctttaccgggatatgtggcaggcgcatatcggcgcaaaggatcatatgtaagggggtgttgtcaaatgtatggaacattgaaaaaaatttttgcgtttgctggcagcaaagagggactgctgaaaaaatccctgctgtttgcgttcctctccggcctgtttgcggctttacagtttgccgccctctttatcgtggtggaggcgttggtatccgataaccgggacagccggtttatctggatttctttgggcatcatggctgtttccctggttggaaggatcatcacgacctatttctccacgatggagcagacggaaaccggctactgtatggtggcggaaaagcgtatccacatcggagaccggctgcgttacatcccgatgggatattttaacaagaacagtatcgggaacattaccgctatcgttaccaccacgttaggggatgtggaaaattcggcggcgcgtgtgctggtatctgtgttgggcggatttttcaattcggtggcgcttgtcatcgttttggtggtttttgactggcggatcggtctgattgccgcagtcggcgtcctgctttatcttgcagcggcggaactggcgctccgcaaatctgagcgcttaagcggagtgcggcagcatacacaggaaagccttgtggaatccgtcctggagtatatccaggggatggggatcgtgaaagccttcggtatggagaaggacagcacacagtccattgacagcgcaatcaaggcaagctgccgggacaatttgaaactgacaaaagccagtgtcccctatgatgccctgaaacaggttgttgtccgggtgttcagtgttttgctgctcctggcctccatttacttctggctgaacggttccctgtcattggcctatggcgtgattttggtgatcgcttcctttatggtgttcaatgatctggaaaacgccggaaacatggcctccctgctgcaaatgctggcggcttctatggatacggcaaactctattgacgatacgccggtcatggatgaaaagggcgcagatgtggttccggcatcctcggaaattatatttgataatgtggacttttcctatgcagaccgaaaaattctggatcatgtcagctttacgatccctgccggaacgaccactgccattgtcggcccgtccggttctggcaagacgactatgtgcaacctgattgcccgattttgggatgtagacgccgggagaattacggttggcggcaaagatgtccgggattttaaactggacagcctgatgaagaatatcggcatggtatttcagaacgtgtatctgtttgccgattcgattgagaacaacatcaaattcggctgcccggatgccacgcacgaacaggtggtagaggcggcgaaaaaggcttgctgccatgaatttatttccgccctgaccgacgggtatgatacggtgatcggggaaggcggaggaaccctgtccggtggtgagaagcagcgtatttccattgcccgcgccatattgaaagacgccccgattatcattctggatgaagccacaagcagcgttgacccggaaaatgaagaagaattgcagcgggcgattgcggaattgacgcacgacaagactattattatgatcgcccaccgtctgaaaaccgtccggggtgcggatcagatattggtattggatgattcccatatcgttcagcgcggcactcatgcagaactgatccagcagaagggtctgtatgcggacttcgtatccgaaaggcaggaagctatcggctggaaactggcacagtaaaggaggcggcaatgaagatttatgcgtcgggcgaggattatttggaagcagtccttgtattgcaaaaggaaaaaggcatggttcgctccgttgaccttgcccgacacatgggattcagtaaaccgagtatcagccatgcagtaggtgtgttaaagaatggcggttttctgaccgtggatgaagatggatatctccatctgaccgaagacgggcgggaggttgctgagaaaatttatgaacggcatcagttctttacggagcagcttgtagctgtcggggttgatcgggaaaccgcagaaagggatgcctgtcggatagaacatgcaatcagcgaagagacttttcagaaattgaaagcttcggttgaaaaacagagcaatgatacagcataacttgaatgaattatttagcacagaaatttgcatctaatcaacagatattatctatatattgtgattgaaatgttgacgcaaacaaaatacagtgctatgataattgcgtaaatagttttatttgggaaatatcctgaataagaaatttcattctggagaggtccgggatttgaaagtagattgtgcgaaaagtacaggagaagtctgttcggacttctgtaatattgattcgggcatcagcctgaaaagacagaaaagacatcaaaaagcaaagaattgttttttggtgtctttttttatgttcaggctggcaaaaggagggaagacaagaacaacctttgatcgaatatatttatataatggattggaatgtggaaaagtggagaacccaaataccttttacccgaattgtattgtacggtaaggaacctggaagagagatttttcaaagaagcggccgaaagaattacaagggattgtaggaaataaaagattggaggaaacagaaacgtatggcaaataccagattatttgacagctggcagattgggatggatctgccggcaccttttgacagggcgatagatggaggcgtgcggtattcaacgaaggaagaggactgttcctgctacaacaaggcgataagggggaaaaagcaacactctttcccgtcgtgctccgtgcggtgctgaacctaatgcggggaggactggtcgatggaaacatcgctgcgggagcgcagcttgccgcagaccggcaggctgcgttctactgtatggagtacacgaaagcatatcagggaaaagcagcttttgcgaaacaaaagaagcagcagaggcgagcaagacagaaaaaagaaacaagagataatctggctaaagaagaaatcttgcaagatgacagatttttctttattgccggttatacctccggaggtgcaccgtatggtgtcacctgggaggaaatgggtctgaaaccttgggaagaaaatgagtgagttgcagtgcaatcttattgacctcttgtgacagaaacggattcccgttttgccggaagtaagtctgaattgatttccggagcatcgagcagcacagagaaattttgctgaatgatttccaaggttttctgctttttctgcaattcctgtttttcccggacagtagcagcctgttcagattcaagattttcaatcagcttttggactttattagggcttgggattttggtaacgccgagatcctgaagctctttttttagtgaatcgtggagctggtattctgcctgatgtttggtgcggtatgcttttggatttttagcagatttacaatcttcaattactttacggcaaagccgataagaatcacagtgtttctgaatgactttctgcgtgctcagttcactgttgatttgtgctattctttggtcggcaactttcacagaagcttcaatgtcagatacatgctgcctgaaatcgtcataattcagcaagttattttcggaaagatagttgaaggtgcgggccgcctctttcaaattattgagctttgcccatcgttcaaatccttctcgattgccggttgtaacatacgtggagatattgatatacaggcgggcttctctggacagatgctttggagcttttactttgctacgattttttgccaggcggatgcgaacattttcttcggaataatagcttccgagagatttcatataagtgaagtttttctgctctggtgcacggaaggacaggtgctttccttggcggatttcatatccggctaactgcatcttttgcagaaattcctcatagttgatggaaacccagattgccttatcaaccgcaacacgtagcttggctttccaactggtgccacgatgatattccatgttctctttatagtttttacctttttctccggttggcatactggtggcaagtccattttcatgacagatacgattgctgattctacaaagtttgtggtagctccgtttattggaaacatacttgtgatgatcaacaaagcttgcagcgttgaagaggatgtgattgtgaatatgatttttgtcaacatgagtactgatcacgtattcatattttcctttcagtacttcgtctgcaaattgttgccctaagcgatgagcggtttcggcatcaacttctccaggcttgaaggactggatcagatgaaatgccaggttatcacctttgtccattccattcttttttgccatttctcttgtcatagaaaattcaagatctgcagtttccggggaacagccaaaactggaaactaacagtttttcatctgttttatctggattcgtgatgtagtccagagctttcttgtctgttactttaacggggaagatcttaagatacgccataattctttcaccatctctttcaattcttgcatttcttccggatatagatctccggtgatatttaccttttttgcaatctggtttatatttacaccaatcttgtgcatttcctcatactgtttcttcagtggagtggtatcggtgttgacgatataaccgtcgattgccatttttcgcagataagctcccatgtttttggtttttgattctatcatcttcctgcggattagcttcctttcttcttcggtgacataaaaatgaatttctttgtttctctttctttcagccattggtgggttctcctttctgagagggcagtagtatcgttgctttcagcgttttttcaatttagggcagggtaccctaaattgggattttccggaagtgtatcctcacttcctgtccttgctgttttacccctctattagttaaagtcaggagaaccggaaaaatgcaaaagaatttggcaggtagtatgggatacgaaaatgtggtatgattatgggcaggatatcagaaaaatcaggagttgaatagattgtgaagaaagaagaaatttttgaatatgtgcagaaacagtatggcacaatgccggaatatttatggagtaaactatcggacagtgcagtacttcgacataaaaatggaaaatggtatgcagtgatcatgacggttgaaaaatcgaaactgggattagagggaaatgatctggttgacattatggatgtaaagtgcaatccagaaatgaccagcatgattattcagacttatggatttttaccaggataccatatggataaacagcactggatcacgattttactggatggttcagtcagtgaagcgaagatattggactttttggatatgagctatgacctgattgacggagcagacggaaaggaagaaaaatgagaacagcgatagtatacgcatctgtgcatcatggaaatacagaaaaattagtaaagaggatcgcagaagaatgtcaggtggatttgattgatgctgtgaaacagccagatgcagacctgagcagttatgatatgattgggtttgcatcaggaatctatttttcaaagtttcatcagtcgatattggaatttgcagagaagaatctaccggacgacaaaaagatatttctgatctgtacttatggcgggagtgcgaattataaaaccatagagcagattttggataaaagacatgccagtgtggttggaaaatttggttgtaaagggtatgacacattcggaccatttaaactggttggaggtattgctaaagaccatccgaatgaagaagatatgaaaaacgcagcggatttcgtaaaaggattacactgatttttgagcaaaaggaaaaccggggattttactcctcggttttctggcagctgtgtttcagtcttcaacctgaaaaatatcttctacaggcactttcaggtaatgtgccagccggattgcaatctcaagagagggattacgttctccacgttcgatgcggcctatagtctggctgcaggaacctatggcttcagccaaatctgcttgaatgagattccgttcttcacgaatatcttttagtgtattattgattgccattcaatcacttcctttgcttattgttatcagcaggatcatgaacctgctgttgaagtctaatgaaatcccggaatttctgcacctttgcatttcccgattacttttccaaaaatcttaaaagagtcagattccaaaacctggataggacgatatttttgatttaaagaaatcagataaacaccatctggctcatcgtgtaattccttgatgtaagtattgccgttgagatagaagattccaatttcaccattagcaagagaatcttttttctgaatccatgcaacatcgtctgtatgataaagtggctccatactgtcaccggaaatccgtacaccaaagtcagtctgctcaggagcaaggtgtcctacatcataggtttcttttacagaatcctccaggtaatttccagtaccagcagaaactggttcccaggtaatttctacaggatgatggaatgggataatttttgcagacagtggagaaaactttttagaagctttcaaaatatcagcaaattcaatcaatttatttctgccttcttcattcaatccactcataatgttatatgggttttctccaaagaaggattcatatatatcttcgatatcaagtaactggcaaagtgtcaggaaaacatgtaaagctggttctcgtgcattggtctcccatttggagattgcttttgtagtgacctgaataccttcctgagaaagcaggtctaccagatctgattgagagtatcctttcttttttctattttctgctaatatttccccgaaatcacgcatttgttcgcctcatttctatttgaattttctatatgcattataccgtatgttagaaataaaatcaacaataatctccaaaatggagaaaatacaaccaagatgttacttgactatctccggaatgtcgatatatactaaacatacaaaaattgataagacatcatgttgaaggaaacagctgggaggtgaaaagtttgagtgagcgtgtgatcctgcatagtgatatgaactgtttttatgccagtgtagaaatgctgcatcatccggaatttgccggaatgccgctggcagtcggtggcgatccggaagccagacatgggattgtgctgacagcaaattatattgcaaagcaaaaaggtgtaaagaccggaatggcattatggcaggcaaaacagatttgtccggaaatcatatttgtaccaccacggatggatttgtatttgagattttcaaagatggcaagagaaatctattcggagtatacggacaagattgagccatatggaattgatgaagcctggctggatgtatcggacagcagaaatctgaaaggaagcggaatgacgattgcaagagaaatcagccatcggattaaatacgaactgggtgtaacggtaagtattggaatttcctggaataagatttatgcgaaacttggttcagattataaaaagccggatgcaatcacagagtttaatcgagaaaattataaagacaggatatggcagcttccagcgtcagatttgctttatgtcggaagacagacaaataagaaattgcaaaaacttggaatccggacaatcgggcaacttgcggaatcagacgaaaagttgttagagagtcattttggaaaaataggaaatgtattatgggctttcgcaaatggctgggatgaagatccggtttgcaaggaaggatatgaagcaccagtaaagtcgataggtaatagcactacaacaccgagagatctggaaaatgatctggatgtctggatcattcaaatagcattggcagaaagtgtagctgcacgattgcggaaacatggatttaaatgcaaaacagtagaaattacagttcgagataatcgattgtatagtttttccagacagatacatttacgacagccaacgaatattacaaacgagattgtaactgcagcatttcagctatttaaagataattacaaatgggaacatcccattagaagcctgggaatccgagctgcggatcttgtgttagatgatattcccgtgcagttggatttatttggaaatcaggagaaaaaggaaaagttagagaagctggatcgtactgtagatgagatcagacgacggtttggttatttcagtatacagcgagcggcaatgtatcaggataaagtcttatcccacttagacgctggtacgcacacgatccatccacatagttatttccatgggtaattggagggatagatttgaaaaaagcattaaccagaaaacaggaagaaagttatcagtgtattttacgatataccaatgaacatggatatccaccgacaatacgggaatttggaaaattgatcggggtgaaatcaacatcatcagcattttccagaatcaagcagttggagttaaatggatatatccgcagaatcccggcatcgccaagagcaattgagattttatagtgaggtgtcggcatgaacaaagtatatgtagatgtagtagcagagtttcggaaaaacggacagctggttcccatattttttacatgggaggatggaagaaagtatagcattgacagaattttgaaaatcgagcgatgcgccagcagaaaggcaggcggtgtaggaatgatgtacacctgtatgatacaagggcaggaaagccacttgttttacgaagtggataaatggtttatggagagaaaaacagcataaggagagcttggtatagacgatattatttggattattaaccggcagggatagtcactttccctttttattcctgcaggttttacataagaagatggattccggtcagcaaaggcagctcccacaatgccttttggatatccgcttctgcaagttgtagtaagtaattgcttcccatcaaaatcatggggaaagcgaactggtctgaaagaccgccagttagtgtgatgatgataaggagattttgaaactgatgacagacagagattatgcaattaaatcaatgaaagagattaccttccagatggcaagccatgcacaggattatttggaagtaacgattgaaagacattatactgatattaaagaattgatgacaagctatcagaaattgattttggaaaatcagattgtgttagaagaactggatatggagtgccaggagaaaatcaatgaagatatggcatatgcgttgagttatctgagcatttataacaatcagctgaatgtgccaaagatgcaccgggaaatgaataacctgatgatcatttatggcttgtcagatatgatctatcgtggaatgacactggttaagttctatgcaccgaatggtgtgatgctcagtgagatccttcattcctgtttttgcagtcattataataagacagatgtggaagtacaacaggagttaggaataggcaggacttcattttataaaatgaagaagcaggcacttgggtatttaggattttatttttatgagatcgtggtaccgcaggcaaaggataaaagatttaaaccgtcactgggcgtagaggaagagtaggtgaataatatgagatacgaagattcgatgaaaggtgtagctgatcagataatcaaagaacagcaacgagccagtaaaattaaaaacaatccagaagagttccattggcatgacgaatatgcaacgttgaatttctttcggtttatctgcaaaaatatcggtaacttgggaaatggagaaattgaaaaaatggtcacacgcttaaagagcatagatcagaaagcagtggaaaaccatgtgaatggtgctgtttgggcatttgattatgataagatgttctgtgtattgatggaaaatgaaatttgccgaaaggtgtgtgaaaagaataaatataatagttggacgaagctgattggacagtattgtatttcaatggcttaaagataaagaaagttgctggagagaaaaaatattctccagcaactttgtctttgatgaataaaggtcaaattttcatttaactattctcactattatttgattcagtgatttttttcttctttggagaaaccagtttgtgaccggaataaatggacatgccaatacaaagcaatgaagaataggcaaagtatttatgtgcagtcatagattttttgattccagaataaatgcatcccaacatacagaaaagtgcgcctaaggaccagtatttatgtgatttcatgatttgatacctcctttgatttaactgattcaatcataacgcttttttacgaaaatgcaaagaaaatcttgaaatatagttctatagaattagaacttggttttgcgattctgtatattgaagacatccacaagtatactaaatccagaacgattattcgttccggaggaggtgttacgatggatttgaaagcagtaggacagcgaatcaaatcggcacgagaagcaaaaaatctcacacaagaggaactggctgcattagtaaatttaagcccgacgcatgtgagtgtaatagagagaggcttgaaagttacaaaattggatacctttgttgcaattgcaaatgcgttagatgtttctgcagatactcttttaattgatgttgtggcacattcagttacaggtgttacaaatgaactgacagaaaaaattgaaaaacttccaatcaaagaacagaaaaaaatcatcaaagtaattcacacattattggaagagtgatatgacaaactgggaagagcaagtagctcttctttttttgaccatttattcagatttaagttgtaaagtgtcttttcatgataatagaaatatgctaaattggttctatagaacaagttgtaaatccagttatatatcggaggaaaatgaatgagagaaaaaactatttatgagaagattgcagaaaagtacaacacaacaccagaagaagtacgcagagaaatgcagatagccatagatgcaggatttgataatcctgatccggctgtgcaggaagaatggaagaaaatgacacttaaaggagaaagacctacaccggaagaagtaatcaattacgcagtaaaaaaactaaaaggaaaataaaaatatgaagaaaaagataattgcattgatttcaggagcagtgatcttgataattgctgcaggaagtatttatgggaaatctgaatctggtcataaggaaggcgaaccggatgtagttggaacattttccgtaaatcgggatgaaaatttaaccgtggttgctaaccggaaaaatattgaggatagagaagcgtttgtaagagagcttttgcagatgtacaaggatgattctttttattcgacaaaattctccacagacaggggatatgcgacgagtcttgatatgaacatctatttatggaaagaggatattgaagatggggaatcggtaatgacagccgaatacagacctgtagaatatggaaaggactatgatgtagtcaataatcctgataaatttcaactatatatagatggaaaagaagtagaagaataacacggtgaactttttatactgaaatatgtacgattccaataatgatatgaacttatgggaacatattgcggatactttgtgaactttatcctgatacaatgattatgctgatgaaagaaggcatagataactgaatacaagaaagagacgaaagcctcagtagttaagaaaaaactactggggctttttttcgtgcctgaatttctcagccaataactgcgggcgtatcccggcaggataaaggcggagcaggcatgattctaaacagaggtccgccttctggatttgaaacgagcaacaagatttcaaatttaggaggaacggatatgtacattgaacacccatatttttatgaaggaaagtactacgcaaatattgatggagaaatgatcgagattacaaaagaagttgcgtatgcgatgaacaatttttacagaagtagcaaggcaaaaaaagttgagattaagaacgaattaggagaggtcgtggataagatgctgcgggaggtaccttacagtggacagtctattgatggagaaggattcatgattgaggatttcccggatttgaactgtgatgtggagcacagtgtactgacaaaaatggaacagcaggatattcacaaagtgatcgataagctgaatgcggaggaacgcatgattatttatggcattttctttgaaaataagactcagacgcagatggcagagattatggggatttccagacaagtattagcgtacaagctgaaaacgatccttaataaaatgcgtgaaatgtatatgaaagaatttttttaaaaaattttgaaaattttttgcatctgccgaagtcatttgactttagtaattagaggagctttaaggactccctaaattgcaccatgataactgaatatccaataataactgacgtgacatttcatacagtgagcacgaggaagatgccgctataggattataagacgtaaaaacatttttagagctaataatgctgcgaaaaagcactgaccaaagccagttggcaggctggtgatgcgaggacatgtgtgagatgcgatacacttgcagaccctgagaagtctgtaactggtaaacctatgaactgccagagcctggaaatgagagtttttgggttgtggtccggagtgtagcatccggacaggttattattcccttcctgcagatgcaggagtaacgattcggggtatcgaggataaatagaatcgagcgagcactgtttaataatcaaattggctatagaggttatgcggcagagctttccagcttggaaaggaactctgccgtatccctgtggagccaatatagcgctatgaatgctttacaaataaaaaaagattggagagatgacaagtgacgattcgaagaggagatatcttatgggcagatctcggtatgtttcctacaacatctgttcagggtggtgtaagaccggtgatcgtagtgagcaataataaagccaatacatacagttcagtcataacggtagttccgctgacatcaagaatatataagaaacggtatttgccaacacatgtatttatcagtaaatatgatatgacgggaatccgaaaaggaagtttggcactggctgaacaggttatgagcatttccacaaaatgtattattgagaaatgcggaagagtaaataagtggatcctggatcgggtactgaaagcagtacggattcagatgggaatggaaggagaagtgcatgacggcagaagaatatagaaactatctggaaacggattttgatgatgtggatctgaaggaattgaaggatatccgaaaaataaggattgaccggaatcagacgaaggaaaaaagaatagctcaatatctcagacaggtgggaaatccctatcttgtctgtataggaaatgtaaaagtgaaaataaggtttgcaaacaatggagtatcttttgaagatgcatttgaggaacttttgctttctgtataaaaagtgatggtaaaatctgaagagttatgttaatatggagacgaggaattcaggactcctcattcatatcaggacaaaatcgactcaccctctgggttttaccaatgttgatggaaaggtaaaactaaggaggatgaagatgaatcaaattaacaattcaaagaaaatctatcatgcagccatttatgttcgtttatcgaaagaagatggcgatgttgctactgctggaaagcgtgaaagcaacagtatctcaaatcagaaagatctgataaaaaatttcctaaaagataaaaaggatatagttgttgtatcagaacgggtggatgacggttacagcggttctaattttgaacgtcctgcatttcagatgatgctggaagatatcaaaaaaggaattgtggattgtgtcgttgtaaaagacctttcccgttttggacgtgagtatattgatgccggaaaatatatcgaaagattatttccggcacttggcgtgcggtttattgcggtcaatgatcattatgacagcctggaagggaaaagtcaggcagacgaaatcgtgattcctttcaagaatctcattaacgatgcatattgccgtgacatttctatcaaaataagaagccacctggaagtaaagagaaaaaatggggaatatattggagcgtttacaccgtatggctaccagaaagattcagataataaaaacaaactggtgctagatgcatatgcggcaggtatcgtcaaagaaatttaccgcatgaaattatcaggtatgagccagacagcaattgccaatgcattgaacaaacagggtgttctttcaccaatggaatataagcacagtcttggaataaggattcaggataattttaaaacacacgaacaggcagagtggagcgccatgtcggtaaaaagaatccttgaaaatgaagtatacactggaactctggtgcagggaaaaagaacaacaccaaaccataaagtaaaaaaattgatgaaaaagccggagacagattgggttagaattgaaaaaaatcatgaggctatcgtatcagaacgagaatttgcactggtgcagagattattagggatagatacaaggacttctccgaacgaggaaaaggtatatccattatctggacttgcggtttgtggagactgtggggcaatgatgatcaaacgggatgttccggcaggaggaaaggtatacgcttactatatctgttccagacatgcggctacgaaagcgtgtgcagcacacagaataccaatgggtaaactagaagaaacagtattggaactggtaaaaatccatattgagaatatccttgatatgaaaaaaatcatggattttatccatgaagtaccatttcaagaattggatataaaagaactggaaattagaaaagaagcaaaagaaaaagaagccgtgcgatgccgggagttaagagattatctatatgaggatttccgtgaaggaatcatttcaaaagaagattataaagagcttcatgacgggtacacagaaaaacggaaaaaagccgaggaagcagtccgaagcattgatcaacagatcagtgaagtcctggaatcaaaaagtgataaatatcattggcttgattattttgccgagcatcagaatatacaggaacttacaagaactgttgctgttgaactgattgaccagatattagtatatgacaaaaaacatattgaagtcagatttaattttgatgattgttatcaatctctgttacggcagatacagtcggtgggatgcgatgtcagcacaggtatggacggaagaatagaaattcaaaagagggaggtcgtataaatggctcgaaaatcaagaaaagtagattatgtaaatgttggaaataaagaaaatttggttacagaagctgaaaaccagtgtgaaaaagtttcacatgcagccctttatgcaaggctttcctatgagagtgaaaagaacagagaaagaaatacgatagaaacgcagatggttctgcttcataatttcgtaaaagaacagaaagatatcgtggttgcaaaggaatattatgatatatctaaaaccggaactaattttgagagagatggttttaatgagatgatgcaggacatcaaagagggaaatattgactgtgttattgttaaagatctttctagacttggaagaaattatgtagaggcaggaagctatattgaaagagtgttcccattctttaatgtgcgttttatttcggtgaatgatcattatgattcgttcagagatgacataagcctgctgatcagcatgtcaaacgtgtataatgagttttattccagagatttggcaaagaaaataagaagttcataccggacgagctgggcaaatggcgaatttccttccggtcagatggcttatggttatgaaaaagacaaggataatcctcatcagctgattccagatccggtagcagcaccagtggtgaaaaagatatttcagtattttattgatggaatgacttatgcagagattgcccggaaattaaatgcggatgggtatctctgcccgaaagcctacaagctggataaagcaggaaaagcaaatgaaaagtcagcgacatggacatggagtggaggaacagtccacaaaatccttgagaatcaatattatgccggtgatagtgtgcataatcagtttaccaatgattcctgggcagcacagagacagaaaatgaatcagaaagaagaatggatcatcatcaaaaatacccatgaggcacttgtgagcagaaaggattttgatgaggtacaggaaaagattggtcatatcgtaaaacgggttaatgaagctcgtaaatcaaatggcaataatgtaagagacttcaactttttcaagcagaaaattgtatgtgcagactgtggaaaaaccatgtatttatatgggaaaacaaaaggcaatcatcgtaggttttactgtggaaataataagctctacgggaagtgtacgccacattctatcactgatttggaagtgaatgattatgtactgcgtgtgatacgtgcacatatcaatgtatatgttgaaaatgtagatttgattcggcggttgaatcaaagacaggaaagcattaaaaaatatgatgtgtttaacagggaaatcaagaaatgccggaaagaactggaaaaagtggcagtacaccgggaaagattgtttgaggattatgtgtgccgtattattgatgcagagcagtatgaaacattttcaaagcaggatgcggaaacagaaaaagagatccagaataacatggaaattttattaaagcatcaggttggatatgaaaaaaattttcacacagaggaagaatgggaaacattgatcaataaataccgcaatacgagaacgctgacaaaggaaatggtcaatgcttttgtagaaaaaatcgaaatacatgaaagcggttctattacggtacgtttggtgtatgatgatatgttggaagaattaagaaaatatgcaaaagaacgggaggctgagttatgccagtaacagaatgtatcgctgtttatatcagactttcgtcggaggataatgatgtagatggcagtataaaagccgaaagtaacagtgtcagtgcacagagaatgctgataaacgaatttatcaaaaaacaggacgaatttgctaactgtccagtagttgaatatgtagacgatgggtacagtggtacaaactttaaccgtcctggctttcagaggatgatggaagatgcaaaagcaggacgtataaaaagtattgttataaaggacttttcaagatttggaagagattatctggaagtggggaattatctggaaaaaatcctgccagtccttggtattcgaattatctcaattaacgatggctttgacagtatcaattcctctggttttactggaggaatgagtgtagcgttaaaaaatatgctgaatgcaatgtacagcaaagatttgtccagaaaagttcgttctgctatgaaaacacatgctaaaaacggtgaatatatgccggcttttcccaaatatggatatattaaagatccagaagataagcatcatctggttatagacccagaagcggctgaaatagtgaaactgatattcacaatggcggcagatgggaaaacaaaaggacagatagcaaaatatctgaacgaaacccatgtgcttacatgccgggagtatatgtgcagaaaaggtataaaaatgcacagagaaaacgaaaaagaaaagaaactctggtcagtcacgacaatctcagatatgctcaaaaatgaagtgtatcttggaaaaattatttggaataaaaagagagtggcaagaacaggaagcaataaattggtttccaatgataaagaggagtggattgttgtagaaaatgcacatgaaccaattatatccgatgaattattccggaaagcaaatgagaaagcgtttactaaccagaaaaaagttcttgcaaaaagaggagtagcctgccctattttcttttgcccgacctgtggaagaagacttggttttaccagcagagagactgggtatcgctgtatgcaggcacatatcagcggtcttagtgggtgtgcggaaagtaaaatggacaggaaagaagcagaagaaacagtactggatgcagccagaaatatggcacaattcatttcggaaaatcttgagaaaaagaaaagagaatggcataaaacaattttgaaagaagaaaatatcgcaacactggaaagtgaaaaaaagcgactctcgtcaagaaaaatgaaactgtattctgattatcgttcagaagtgttggacaaggaagggtatatggaagaactggaaaaaacgacttcccgtatttcagaaatcactttgcagatagcagaattggagaatgagattgcagtagcgaagaaaaaatgtgatgaagcaacagaaaaagaaatggaagtaaatgagattgcagcattgcaggattttgacaaaatacagctgtcaaagattattgagaaagtctttatttatgaaccaggtcgtatggagataagctggaagatggatgacattttctacaaagaagaaaaagcataaacggaataagattgttcgcaggagcatcactggatgaaaacagtggtgctttttgcgaattaaaagcaaattttttttagacttatattgacaaaagcagactgttaaaaattgaatgggaagccataggggttgatatacgcagaatccggtattccctaaaggatcttgcagtcatgtatgaaatgtccggtatccggccgaagtttcagaggattgaagaaaatatgatggctgttgaaaaccttcttcattcggtcaaaggactgtggataaaagaatatttaattcgctgcatgaaacggttggagcagggcaagatcccgcaggaattttcaaaaagggatgcattgttccggtgccttaaagtgatcgacgggctgaaagagccgctgtataaaagggtcttcagcaaatactgtctgggggattccaagctgtttgagaatagtctggagagcattgtgctttccatagccagaaaatatcatgaggatatagaagagggaatgaacaatacgcagattctttcacagcttttgatcgaagaatattctcaggagctggccgtaaaggggcctctgcggatatcagtgaacggacaggaaataaatctcgggcagttttgctacggcgcggtcttaaattcacagatgctggtccatgcgaagccgctggcaggtcaaaatataaaaagaatcctgacaatagaaaacaaggcaaactatatggcgacgccctatgacgaagaagccgtcatcatttacagccatgggttcttcaccccaaaagaacgggaatttctcatcagcctgcgaaatgttctttgtccggagacacagtatttgcattccggagatttggattacggcggtatcctgatctaccggtatatcaaacaaaaaatatttccagatcttatgccttttcaaatggatggagaaatctatcataaatatgagaagtatgcggtaaaaatggaacctgagactttaaagaaactcaaaaaaatgcaaatgaatggaagcccagaattggcggagctaagagaacttctgtccagagagggaaaaggcctggagcaggagagttttttactggcatccgatgaaaccgcaggggaaaacggaacttagatgccggcaaaaacgggaaactgatctcagtcagatattccgaaaatgagaaaatatagatttgttccttttaactccttttccatacttttttccagttgtaagagtccttctctgatatggcacggttcatcgcacagaggtgctctggtgcactcatatccttctttaaagcaggcattgatgccgaagccgctgccgaggccatgcattagctgaaagaggcttatgtcatgcaggtctgctgtcaggcggcatccgccttctgctcctctggtaatgatgatccatccggctgtctccagttttttaatgatacggtatgcaaactgttttggtgtcgcttccagagagcatatttcttctattgagcgtttctttccgtcacttaaagcccttaaaatgcgcagggcataatcggtttctcttgagatcagcatgtatttctccctccttatcttagtgaaaatataccagactaaaaaatagctgtcaatggaacccagtgaattctttaagggaaaaaccagacccgccaatattaagtgcggacctggtttttctgggttagaacatttttactgtttgatggattctatgagaccgtcagcttatatatccataccaggcagtgttcattacctccaacccaatataaatctttggtaacttttctaacacaatgtatggatcatacctccttttgatcagtcatccaaacgcaggaacgcttaaacttcaataaacatgtcttttgattcaccacagtccggacagatccactcttccggaagtttttcaaacagagtgcccggatcgatatcaccctcgggatctccgttcgccggattttcctccacatccccgacaatgccgtagtctgcatttttaaagatcggtgcgttcgcattggtattgatcgctacgatggttgtggcatctttggttcctcttaaatgccgccctgctccggaaatgccgcaggcgatgtacaggttgcccttaaatttctgtcaggacattcctacatacgctttgtcggcgttggtgataaagatcttgcctccgtttaacacgtaatgatcgccatcaactctggaaagttcttctacagcaatggcatagctcaggacatcagatcccgcgccccgtattcttttggatactgcagtcccatcatacctgttttggcaaacttttcgatggcttctgtcggaaattaattttctttgtctaagaggaaggtgagaggttttatttcggtttctgcaaattccatgaatttcgcacgcgggcttcatgagcttcggttgtttgaaataacatatagagcctcctttgattataaatttttttgtgaagaaaacaccgtaagggataccttgattaaagatacttcggagagtgtgatctcacggtaaggcatttagaatactataattgtaatgtgaaaaatataaactttattaagtttgtgtagtttaatgaaaaaatgataaaataactgtgagtattgccagttccattttctgcataagttttttatcactatttccgtcacgctttaaaatgcgttcctccaatagtgataaaatactatcgttgaatggcttgacttgattgatggatacttatctgaagaaactatgtccaagttggctatttaggagacttacgtctttgaaacagcaagccggaaaatttgtcacaatattttgctgatttcccaaccgataaaatcgataagtgtgagtaaaccacgggaaatagccatttgaggccacattggagaaaaatgtgagaaaattgacggtggttgggaaaaatatagagaaacgttgattttatcagagaaactgactataatgaaaaagaagaatggcttaaaagtgttggataaacagtaacaagagttgtattgaaatctaaacacattcatccctgtagtgatcggatctgaggataaacagtaacaagagttgtattgaaattttctgttctggacggcccttccgtcttggctacgataaacagtaacaagagttgtattgaaatacagctattatggggaatatgaagatggatacacgataaacagtaacaagagttgtattgaaattgttttttgtccaattccttcggatgctgttaaattgataaacagtaacaagagttgtattgaaattcttttctgatctcgaaccgttttattgcaaattctgataaacagtaacaagagttgtattgaaatttgtaatagatgcattttagagtctggtttttttctgataaacagtaacaagagttgtattgaaattcttatttggatactccatgtttatcacctctttcggataaacagtaacaagagttgtattgaaatggcgtttgaacagcttgtgaaagaagggattacagataaacagtaacaagagttgtattgaaatgacactccattacggacattacagagcggatatatgataaacagtaacaagagtaaattgtgttatctatgataagagaaaactaaccgcatctgtatacgacactatttatagaatcggagtattatttaattcttaagtaaaggaatatttgaagaagaaataagttgtaccctgatagttaggcacagaaaaggattctgtgattaactaccagggtatttatctgtatgtcaaaccttatcgcgcaaagcgcgcgcacccgaagggtatagaatacggggtgccctgtgggtataccttatcgcgcaaagcgcgcccacccgaagggtatagaatacggggtgccctgtgggtataaattaatctaatttttgtatacatatgatttttctaaaaaaactcttccgctctttcttatttctatgttacagtataaattagtattttctgtccggaaacgaaaaaatgtgtcggacagagagtgattttaacgaatgacgatggaggagattgaattggtaacgatagcaaattatttaaggccggaaagtctttcagatgcatataagctgaatcaaaaaaagacaaaccgggtccttggggggatgatgtggctgagactttgttccccgcgcatacaaaatgccattgatttgtccggacttgatttagactacattaaggaaacagaagaagcatttgagatcggagctatgtgttccctgaggagcctggaaactcatccggagctggaggcttatttttgcggggcaataaaggaaagtgtgcggcatatcgtgggtgtccagttcaggaaccaggccacggtagggggaagtatctatggaagatttggattttctgacgtgctgacctgtctgcttgcccttgacacggaagtggtgctggtccatgcaggaaaaatgactttggctgaatttgctgacaggaagcgtgaccgtgatattttagagaagatcatcattaaaaaagatgggcgcagagtcgcttatctgtcccagagggcgacaaagaccgatttccctgtggctgcatgtgctgtatcaaaaaaggaagatatctggtatgtctctgtgggagcaaggccggcgaaggctgagcttgctgtgatccatgggcaaccggcagatactttagccgaaaaggcagtcgctgacatgaaatttggaagcaatatgagaggcagcgctgaatatcgggaagcggtagcaaaagttctcgtgaggcgcgctgcaaatgctgtattggaggagtcatagggatggaagtgaaatttcagttaaacggaaagccggcggcagctgatatagagccggactgcatgctgctggatttattgagagatatgagatgttacagtgtaaaacggggatgcgacacaaccaactgtggcctgtgtaccgttctggtgaatggaaagccgagtctttcctgtgccatgccggcagccagagcagaaggaaaagaaatcataactttagaagggcttcaggaagaggcggtagtctttggaaggttcctcgcaaaagaaggggcagaacagtgcggatactgttctccgggatttatcatgaacgtgattgcgatgatgagggaattaaaagatccgtctattgaggaaataaaagagtacctggcagggaacctctgccggtgttccggatatgagggccagatgcgcgctatccggaattacatgaaagaaaaaggagcacagtaacatgaatttagtcaatacttctgtcccaaaagtagattccatggcattggtgaccggaaaacctgtctatacggatgacctggctccgaaagactgcctgatcgtaaaggttttaagaagtccccatgcccatgccaagatcaggaaaatagaaacggaaagagcactgaaagttccgggaatcgagtgtgttttgacccatgaagactgttcggataagagatttaccatggcaggacagacctatccggaaccgagcccctatgaccgcaggattttagatgaccgggtgcgttttgttggagatgcggtggcagttatcgcaggtgtctctgaaaaagcagtggcaaaggccatgaagcttgtaaaggttgattacgaagtgctggagccggtcctggatttcaggaaagcgaaagatcatgagatcctggtgcatccggaggaaaactggaaagctctctgtgaggtaggggcggacaataagagaaatctctgtgcccgcagtgagacacaggaaggcgatattgatcaggtactgaaagattgtaaatattacgtagaggagacttatcacacgaaagcaaaccagcaggctatgatggaaaacttctgtacgtttacgcatatggacgcatatggaaggctcaatgtggtgtcctccacgcaggttacattccatgtgagaagaatcctgtccaacgccctggatattccaaagtcaaaaatccgagtggtaaagccaaggattggaggaggctttggggcgaagcagacggtggtcacggaagtctatccggccctggtgaccatgaagacaggaaagcccgcaaagatcgtctacacaagagaagaatctttcatcgcatccagtccgcggcatgagatggaaatcaccgtgcgcatcggtgcagatgaaaatggaattattaaaggaattgatgtatataccctgtcaaatacaggggcatacggagagcatggtccgacgaccgttgggctttccggacataagtccattcctctgtacggcaaggcagaagcattccgttttgcctacgatgtagtctataccaatgttatgtctgccggggcttaccggggatacggagctacccagggtatttttgccgtggaatccgcagtaaatgaactggctcacaagatgggcatggacccggtgaagttaaaagaactgaacatggtgaagaaaggccagaagatgcctgcttactatggagagacagcaacaagctgtgcactggacaagtgtgtggagcgggtaaaagaaatgatctcatgggatgagaaatatccaagaaaagacatgggcaacggaaaagtgaggggtgtcggcctggcgttagctatgcagggctctggcatttccaatgtggacacggctgcggtgacgatcaaagtaaacgacgatggattttacagtctgatcatcggtgcttctgatatgggaaccggatgtgacacgattcttgcccagatggcggcagactgtctggactgtgatatggatcagatcattgtccacggagtggatacagatgtttccccgtatgatacaggatcctacgcatccagcacaacttatgtgaccgggatggcggtggtgaagacttgtgaggtattgaaagaaaagattttaaaaaaaggtgcccagtacctgtcctgtccgccggaagaagcagagtttgacggaaagagagtgttccacccggaaagcggaaaagaaatatcattaaaagatataggcaatcaggtgatgtgcggaaatgaggaagcgcttcaggcaagtgaatcccattactccccgacttctccgcctccgtttatggcaggggccgcagaagtggaagtggatttggagacaggggcagtggaactgattgattttgcggctgtggtggactgtggaaccgtcattaatccaaaccttgcaaaagtccagaccgagggaggcattgctcagggaatcggaatggccttgtatgaagaaatcctttacaatgaaaaagggaagacatcggccaactcttttatgcagtacaagattcctacaagacaggacatcggaaatatccggatagaatttcagagcagctatgagccgacagggccttttggggcaaaatccatcggagaaattgtcatcaataccccgagtccggcaatcgctgaggcagtatacaatgcgtcaggagtgcgtgtgagagaactgccgattacagcagagaagatctacatggggatgaaagaaaaataagaaaactgaagaatcttttataaaagaagagtctatgagagaaaatctttcaggactcttctttcttcatactatgagtgacacaaagttgtttatagtaacgaaggaggtataaattatgcttataaaagattttctggttgtaattgctgttttgtttattttgcctgtatcatttgatgaaacagagaactttagaaaagtagtattggatcgtttgttatatggttcattaacatattgttcaacgagaataaacagcatggttcgtaaaattttcggataccaccacagtgaaaacgaagagatagaacaggtgttggaaataacttatctaggggttctgttattatttgcaggctattatctttataaaagagatgcaaattggtttaaagtgatttcacttatagagaagcaactaaaaagtgggcatctagataaaggaaattttattttgtttgtaatatccatttcataccttttctggagtatgatgattgtttcaaataatccggattttctgagagactatctaataagaaccgcagcatatttaatatttcaaaaattgtgccaaatgaatagacgtacttgagaattttaataataaaatacttatgaaaacttttatttacttttgttcagttatgtattgcttttttatattacctgtggtaatataaaatcataaacacaagtaaacgaagcataacgcaggtaaacgaaatggagggtgcagagatgaagatcacggcagaacagttggcaggtatggtggatcacacgaatttaaaggcatttgcagacagagtaatgtttgaaaagctttgcggcgaggcgaaagagtaccagttcaagatggtagcgatcaatccggcacagatcagtctgtgtaaagaactgttggatggaagcccggtacatgtgggtgcagccatcggatttcctctgggtcagaccacactcgagtgcaaagtcttcgagaccaatgatgctatagaaaaaggagccgatgaaatcgattatgtcatcaatgtggcggaagtaaaaaacaatcattacggatacataaaagaagagatggagcagatcgtcgctgtctgcagaaaggcaggggtcatcagcaaagtgatcttcgaaaactgttatctcactgacgaagaaaagcaaaaagttgctgaaattgcaaaacaagtgaagccggattttataaaaacttctacgggatttggaaccggaggggccacagtggaagacgtccggctgatgaaatctgttgtgggcgatgaggtgaaggtaaaagccgcgggaggcatcagagatctgaaaacggcccttgccatgatagaagccggtgcagagcggctcggaacgagtgcaggtgttgagattgtaaaagaaatgcatgaataaggggaggaaaagaagatgagagaagtcaaagtatgtctgatcggctccgggagggcaggaatggtccacgcacataattacacaggaagcgttcccaatgcaaggattatcgcagtctgtgacccggtggaggaaacagcaaaaaatgcggcagaagaactggggattgatcagtattatacagattacagagatgtcctgaaaaatgacgagatcaatgcggtttacatcgtgacgccgaccaagtaccacaaagagatcgcagtggccgcagcccaggcaaagaagcacattttctgtgaaaagcctatggctatgaacgagaaagaatgtgacgagatgatcaaggctgccgatgaaaacaatgtaaagcttcaaattggatttatgcgtcgtttcgacgagagcttccaggaagcaaaacggatgatcgcagaaggggaaatcggcgatattgtcctggtcaaatctcattccagagggcccagtaaaccaaaagagtggatgtttgatatcaagaagagcaacgggcctttggcagaggtcagcagccatgatattgacacggtccgctggttcgcggagagtgaacttgagagcgtgtacgccataggagggaatttcagaaataaagagattgccgaacagtacccggatttctatgacaatgtcatcatgaccggagagtttgccaatgggatacatgcctgcgtggaaggcgcccagtatgtccagtacggatatgatgccagggtagagatcctggggacaaaaggggtgatctgtcttggcgatatccatgaaaagaagattcttacctgtaccccgaaccatgagctgaaacgtccgactacaaggagctggaagttcctgttcaaggatgcctatttagccgaagacaggagttttattcgctctattataaatgatacgcctgtagagtgcagcggttatgacggaaagatggcagtaaggatcgtaaaagcaggaaatgaatccatcgtaaacaaaaagattgtgaaattataaaaagagactgacaggaggaccgtatgtttgcagaagaacgaaaagaagagatcatgaggcttttgaaagaaaataaaagggtgagcagcgccgaactttctgagcggtttcatgtgagcggaacgacggtccgcacctatctgatggaactggaaaatgccgggaggcttacaaggacccacggaggggctctgctgaacgaagatattttaaatgtggaagaatccattgccgcaagaaagcagaaatgtctgagagaaaagcagaaagcagcggcaaaggccaggagcatgattaaggatggagacacgatccttctggacagcggaacgaccatgctggagcttgcaaaactcttaaaggatgcaaaaaagcttacggtcgtgaccaatgacctgcctgctgccatggaacttcaaaaaatggagggcgtctatctgatcctgatcggagggcatgtgcggacagcctttgaaagcacagtgggcagcatgggcatgaaatttcttgaacatatttcggtagaaaaggcattcatgtcatcggacggtgtgtcactgaccaagggcgtcaccacaccaaatatggatcaggcagagatcaaaaaggaaatgatggccgcggcagatcagaattatctcgtatgcgatacgtccaagatcggaaaacgtaccatttgttcgtatgcaaaaatcggagacttcgacggctttatcctggatgaaccgctgtccgatgaaatgaaagaagcatttgaaagctatgggacgattatctattgaggcattgtaaaaatgactgatgatccaaagaagctccctttttttcgacgaccgccgcggagatcagattggccctgcggaccgcgtcggaaagtgaagctccgagttttctaagtgccattacagctcctatgtgggcgtcaccggctccggtggcgtccatttgttttgcacttctggacggaagaaataatccgtttccgttttccaggcagtatgctccgtctttgcccagagtgatcactatatcctgtccggtcaatctgctgatggactgtgcggcatgttctgccgttgtttcgccggacagtatgaaggcctctgcctcattcaaatgtactacaggatgaagtgcaaaaaggcgtttcatcagatctttcggctgtttgtcaatccttggacccggcgcataatagatgtccatatgcggctgctgttctaaaaacgaaacgatgtgttctccggttttttcttcgatttccagtccgcagatataggctgtgtcatagtcggaagcatcaatcagatcaaaccactctttctgaaacagatattcggctccgtggtaagaagcaaaagtccgttcgcctgtctggtcgacaaaacagtagcagcagccgttttcaagatcagggacaggcaggacagggacaactccacgctttctccattcttctctgacaaaatctccatagatcccggtgccggccggagaaaacaacaggtgaggcacctggaaatgccggatgatatcggatacattaaaagcacatccgccgatacagagatgctgatctaagatatgcacatcttccccgggtgccgggagctttttgacatttataattacatcggccacagaggagccgataatcaaaattttctttttcgggttcatattttttcctccatgccttatgatataataaaatccctaaaaataaaacaggataggagaatcattatgacaaagaaaaagattttgaccgttgttccgatgagtgatacatataaagagaagttaagagaggtttccgaaggatgtgatattaggtattcttcttatgaggatgtggacagagaaatggtgcaggaagcaaatatcatcatcggaaatgtccccgcatggatgatcggcatgtcaaaaaatctggaacttttgcagctgaattcttccgggaccgatgcttatatgggcgtgaatattttaaatgacaatacaatcatgaccagcgctaccggcgcctatggaaaagccgtgggggagcatctgtttgccgtgctcatgtctatacaaaagaaacttcacgtataccgggataaccagaaccgctgcgactggtccgatgaagggcaggtcctctcactgaccggaaatacggtgctgatcgcgggactcggagatatcgggctgtcatttgctaaattgatgaaagggctggattcctatgtgatcgggattaagagaaggaagggagagtgtccggagggagtggatgaactgcataccatggaggaactcgatgagctgctcccaaaggctgatgttgtcgtctctattctgccaaatacaccggtaacgcggggtgtgttcggaaagcagcagttcaggacaatgaagaagaccgctgtctttctcaatgcaggccgcggaaatgccgtggatacggaggcgctgtgcaatgctctgatcacgggagagatctatgccgcgggactggatgtaacagatccggaacctctgccccaggaacaccgcctgtggaatattaaaaatgcagtaatcacacctcatatttcaggggacttccatcttccgcagacactggattttatcgcagacatcgcagtggaaaatgtcagaagatatctgagcggagaagaattgcttcatgtagttgattttcagacaggatattgcaaataaacattgtgctctcctggaaaatgatatataataatagtaatttttactgtttattgcattttacaaggggaaaacttgatatcggcggtctcacagtcaacgtggcagtgatctacggcacaggaaatgccagaaaaatgattcataaggtgaggtcttcggataagccatgaaaatgagcagattaagagactttatgaggaattttacgtggagccgttaagcgagctggcagaacagagggggaccgtgccattctttcagttctgctggagaataaggggctgaaaaaagctacgaattatggcaggcaggcttttatgctgaggacccgaatgaaggagagattttgttttgtcttgctcaggcatctcaggctaagaacattccatgggaggctgaaagtcctggatttttcaataatatacgtatttccttttcttgacacattctgttcattagaataaaatatccaatagacttatatatgaaagatggaggatacatatgaaaaccttacaaaaaatcagcagtatgctgtccagcaaaacgtctgtttttgtcattttagtggcaatcgcagccttctttgtcccggatgttttctcctgggtacagggaaataatcagagtcttgtacttggagtcatcatgtttacgatgggattgacattgacgacagaggacttcaaagtgttggcaaaacgcccgctggatatctttatcggagcagcggcacagtatctgataatgccgttccttgcttatgggatttcgactatcctgcgcctgcccaatgagatcgccatcggattaattctcgtcgggtgctgcccgggaggggtatcatctaatatcatgtcatacttatgccatggggatgtgccgttttccgtgggaatgactacggcatccacgcttttgtcaccggtcatgacaccgatgatggtactgtttttggcaggagcgaggatcgaagtcaacgccgcttccatgttcatttcgatcgtgaaatctgtgctgcttccagtcctgctcggatttatactgaatacgttgtttggcaaaaaggaagcattcaaagaagcacagcaggtcatgccgggaatatcagtaatcggactggcattgatcgtcggaggcgtcattgcacttcagggagcgaatttctttaaatccggtgctgtgatatttattgcagtcttgctgcacaacagccttggatatgcccttggctatggagtcggcaaactgacaggaatgaacacagcaaagaaacgcacaatttctattgaagtcggaatgcagaatgcgggacttgctacaaatctggcgacagcccattttgctgcggcacctcaggcggctatggccagtgctgtatcctgtgtatggcactcaatttcaggaactattttggcaggaatctatttacaaaaagataatatgcaggaagaacaggtaaaaaaccgggaagcagcagaaacagaataaaattttacgggatacacttgtattgtacaggcgtatccctgttttatggcttaatttcagagtttttgacgacttttcttggaatttttagatatattgactggcatcctgcaccagaggaatgatgctgctccggtcggtaaagtcaaccagtgtcccataagtgtcaaggattccctgatcttcttccgtccgctcctcaggttttttctttgagagcatttttttcatcatccacatcatgacccggtgctttgtgctgagccgttcataatccattcttcctctgaaatggtaaaaagaaatctgttcttttaatttaccggtgaaaactgaatctaagttttttaaaatatgttctatgttttcaggtttcgcaggatcggcaattccgcaagtgaataaaaacacttttttcttctgaataaattcaggatggcgggagatcagggaaataccggtgactcctccggcataaaggccgccgccgtaaataataatgtcataaggatccaggacagaaatgtccagacttttattttcatatagatctgcggacaaggcgtcggcaatccactgtgcgtactgctttgtggaaccgtaaacggacccgtagacaactgcggttttcttcatatattacattcctccatgtttttcatcatagtattcagggtttccagtgtagttttcagctgtgattctgagatacccttgtataaaagatccataaaatcttcttcctttgaggcatatgcagaatgcagtgactcggcctttctgccaaggcgaacccggcttttgcggcggtcatcggggtctgtttctatttctgcataacccttctgctgaagttttaaagcgatctgctttacattctggtgggaactgcccatcagggaggaaagctcattaaaggttggggcatactcaaaggtattgagagcagccagaagaaaccattgttttgacgtgatctcttcataaaagcggtctccgatcgactggagccggttgctggtcgtaaataatgctgcaaacagcaggtgtctgctgtcgtaatcttccaatttcatagtcaaagcacctcctatatgtaatatattacacaaataataaaatgtcaaagaaaacagaaagaaaccggattccggttgcacaatccggaaaatcatcttacaataaaatcaagtatgagagaaaggcaggatacacaatgccaaaaaaaataacaatggctgttgtggcagagatggcgggagtgacaaaaagcacggtttcccgttattttaatgggggatatgtcaaaaaggctacaagggaaaagatccagaaagtaatcgaagaatataattatgcgccgaatacattcgcaaggctaaaggcaaaggaaagcaatgtgatcggggtcgtagtgcccactctgaattccaaggttaccagccgtgtcatcacaagcattgaccggtatttaagggacaggaattatacaacactgatcaagaattcggatcacgatattgatctggagcttttaaacatacaaaagctgatccatctaaatgtagatgggattttgatcagctctattgcgatcacagaggatcatcacgatatttttgaacagacacagattcccattgttatcctggctcaggattatgaagacgggatttctatcatcgacgatgattacaatgcaggaaaatgtgtgggagaatatatcggaaggacaggtcataagaaagttggatatattggcgtttatgagaccgatgaggccgtaggtgtccggaggcgtcagggagttctggacggacttgcgtcattcggaatttatgatccgctgataaaaaagagtgattacagttttctcggaggacagaaaaatacgagagagatcctggaggaaatgaagccggacgctattgtttgcgccactgaccgcctggcgttcggggcctataaagttttgcaggagaaaggactgcgaattccggaagatatttcggtcgtgggatttggtggatatgacgagagcagtcttttaacgccggagcttacgacactgaaatttgattcgtatgggatgggatatcttggggcggaaacgattctcaagatgataaaagaagaaccgatatccaaaaaacagatcgtagagtatgaatttatagaaggaaagagcgtaaaaaatcgaacataggactgcaaaaaggccataagatccggatttagctggagcttatggcctttttttctgtcagaaaagtctgtctgcgtacaaaatatagagtgaaggcgggaactgttcaggggacaggagacaaaattatgaaagctacggagaagaattttataaatttcataaagaaaaggagggaggaagggctgctctatgcagtggaaacctatagtattttaaataagataaaaacaaaagtcccggagagtgaaagagagctggaagatcaggaagtgacagatcaaatcaaggcaaagtattcatcaataatttagtttttgttgaatacttctaatcaggagtctttaattttgtgcaaaattttatggaaccgataccataaaagtattgacgaaaagaaagaatcgtcctataatacaaatatggaaccgatgccataaatatcgtaaggaggataagaaaaaactatggattatgcaaagattgcaggccaggtcatcgctaacgtgggcggaaaagagaatatcaaatctgtggcacactgtgcgaccaggcttcgttttcagctgaagaataatgacttgagaaatgaagaggccatcagtgacttagaaggggtgaaaggagtctttttaacccagtcacagttccagattatttttggatcaggactcgtaaatctggtctgtgacgaagtacagaaacagattggggatgtctcctcagccggaggagaagaggagaaagaagaaaagcagggctctgtcgtacagcgttttgtaaagatgctcagtgatatttttgtcccgatcatcccggccatcgtggcaggcggtcttctgatgggactgaacaatattttgactgcgggattgtttgacggcagatcgatcattgaattatatccacagtggaaggggctgactcaggcagtcaatacatttgccaacgcaccgtttacatttcttccggtactgatcggattcagcgccacgaaaaagtttggaggcaatccgtttttaggcgcggcaatgggtatgatcatggtacatccagaccttttaaatgcttaccagatcggcatcgggcaggcaccggtatgggatatcttcggattcaacattcaggcgatcggttatcagggaacggtacttcctgttctggcagtttcctggatcctggcccagatcgaaaaaaggcttcacaaagtaacacctacctggcttgacaatcttacgacaccattgctttctattatcgtgactgcatttttaacattcatctgtgtgggaccggtattaagagaagcaggtgacttattagcagacggcatcacatgggtttacaatacacttggcgctgtgggaggcggactctttggttttgtatacgcaccaatcacgatgacaggacttcaccacagctttattgccatcgaaactcagcttctggccgcaaaggcagtgaccggaggaagtttcatctttacgacagcaagtatgaacaatgttgcacagggagcggcagttttagcagtcctgttcctcacaaaagatcagaaacagaagtctatctgttctgcatccggagtatccgcattattgggaatcacggagccggccatgttcggtgtgacattgaaattaaaatatcctttctatgcggcgatcattggtaccgcagtgggaagtgcatatgcggcagctacaagaacactggcacaggcattgggagcagcgggaattcccggatttatatcaatgaaaccggagcatttccttcactttgggatcggattgatcctctccatggtcatttcagcaggactcacggttgtgttctggaaaaaatataaccttggcggtaacgaaaaaacagtaaaaccggtacagacctctgaggaaagagagaaagcgccggaacaggcagaaacagtgctttactcaccgatgaaaggggaagtgctttacatcacagagtctgaggatgctgcattcgcatcgaaagccatgggggacggtgtggccgtcaatccttctgagggcacagtgtacgcgccgtgtgacggtaccgtaactatgatctttccgacgaaacatgcgattgcgattcaggcagaaacaggaaagagttttctgattcacgcgggaattgacacagtaaaaatggaaggggaaggctttgagacattcgtagaagccggaacaaaggtaaaacagggagacaagattctaacgtttgatatggatctcgtgaaagaaaaaggctacagtgctcagactatgatgacgctggcagagggagacggccaggtggaagtcattccaaagactggtgcagatacaaaaacacaggttatgatcgttagataagagggaaatcatgtttaagaagtataataaagtattgaaagaagactatgaaaagtggtatgctgaacatgaaagtgacagagaagagacagcgaaagatccgatgcggcttaagtttcatctgatgcccaagaccggatggctgaacgatcccaacggactgtgccagtttcacggcacctaccatatctattatcagtacaccccgtttgaaccgactggagaactgaagctttgggggcattatacgacaaaagattttgtttcttatatagatgaaggaccggcattatttccggattcggagtttgacgcccacggtgtctactccggttccgcctttgtaaaagaggatacgattcactatttctatacaggaaatatcaagtattttgacagggatgattacgattacgtcaactcaggacggggcagcaacacgattcatgtggccagcaaagacggatatcatttttctgaaaaagagcttttaatgaccacggacgattatcctggagatatgagctgtcatgtgcgagatccgaagatcatccaacgaggggatgattactacatggtccagggagccagggatatggacagccatggactgatcctgatgtttcattcaaaggatctgtctcattgggagtattttgacaggatcgttccgaaagaaccgttcggctatatgtgggagtgtccggacttgtttgagctggacggacagatgatgctgattacctgccctcagggggtagaatcgaaaggcatcgactatcagaatgtgcatcagtgtacagcggtgaggattgactatgactttgagaacaagacatatgagatctgcgataacctggagtttcagcagttagacaggggctttgatttttacgcgccccagacctttgaggatgagaaaggacgccgtatcctgatcggatggatggggattccggatgccggttacgcgaatccgacagttgagcatggatggcagcacgcactgacgataccaagggaactgcacataaaggatggaaggatcattcagcagcccataaaggagacggagcagatgagaaaaggagaactgatctgtacattttctgaacagggcaggatggagagcaatcttaaactgtatgaagcagagattcgattcagacattgtgctgatatggttctgactttaaagaaaggtgtcactttgtcctatggtgacggactgctcacccttgatctgggggattttggtgcgggcaggacgacaagatgtgccggattggatgaattaaaagacctgcggattttcgcagacactacttctcttgaaatttttgtaaacggcggtgaagaagtctttaccaccagggtatacagcagccagggaaagcttggcatagacggggactgttcgggtaccatgaagatctattgcctgcggcccctggagataggagaaagagaatgaccagaaaattatgcggaattggagaggcactgattgattttattccggaagtcaaaggacagagattaaaggatgtaccgtcttttaccagggtagcaggaggggctcctgccaatgtagccggtgcggtgacgaagcttgggattccgtccaagtttttgacaaagcttggagacgatccctttggtgattatatagttgaagtacttgatgaggctggaattgacacaagccatatcaaaagggacaaagaagcagagacggctctcgcctttgtctctctggcatcagacgggaacagggattttaagttttaccgcaagaacagcgcggatctgcgttatagtgtctatgacatcgagccggatgttctggatgactgcgggatgatccatttctgcagcgtagacttggtgaattcgccgatgaaagatgcacataaaaaattaattgacatggctaacggcaaagacgtgcttgtatcatttgatccaaacctccgtttttccctgtgggacgatttacaggaactgaaagagacagtcaatgaatttttgccttttgcggatatcataaaaatctcggatgaagagctggagtttatcacaggacatacggatataagggaggcagtgcctgacctgctgaacggaaggacgaagtatgtcatctatacaaaaggaaaagacggcgcggagatttatacgaaacatggaatgacggaagcacccggatattccattgacgtaagagatacgaccggagcgggtgattcctttatcggagcgtttttataccagcttttgagggatgaagtgagggatctggaagcggtggatttggggactttaaagaagtatctggattttgctaatgcgtatgcggcctgcacgacgacaaaagaaggagcactggcagccatggcagatgcccgggagtttgccgatttcagaaagaatctgcagtaattaaaatacataaaaagcgaaaagccaatgagcctttgaaaaaggtttcgctggctttttttcggtttattgtccgattaatctataatgaagttataattacctcttgacacattatactatgtaatatatagtataatgcataaggaggcgatagattgaatgtacagttgaaaaaagggtttttagagttttgtattttggctgccctctgtgaggatgactcctatggttaccagatcatcaaagatgtatcgggatgtattaagatttccgagtcaactctgtaccccattctgaaacgtctggaaaacagtggatatctgaatacttacacggtggaacacaacagccgtctcagaaagtattacaggataacagaaaagggaagagaccatatcagagaatttttggatgagtggcagcagatcatgggtatttatgagtttgtgaaaggagcggcagaacatgagtaaagaagagtttttaggaagtcttaaccggcttttaaaaagtcttgggaagagtgagagagaaaaatcgctctcctattacaatgaaatcattgacgattatatggaagacggatatacagaggaggaagcggtggagcagatcggctctccggggcagatcgcacaggagattctgaaggaacagcagacacagatgaagacgccgatgtcccgcgggatgaagggattaatcgcagtcctgctggtccttggctttccgctctggggatctttggtgcttgccggattctgtctcgtgctgtctgctgttttgctggtactgtctgcctacattgttatctggtgtattccgatatgtaccggagcagtttcagtggcaggcctgatcctgtcggtagtcagtatgggcggcgcagcagtgatcatttttcagaactctgcggcaggggtcatacagctgggcgttggcatgtcatctgcgggtatttttattctggcaggcctgctgacatggattttaggacaatatttcgtgaaagtaactgtcagattcagtaaatggctggcagggataatcaccgggatgaggaggaaaaaactatgaagatcagaaatttaaaaaagaaatgtcttataatgagtgcggtttttctgattatcgggtctgtccttacaggggccggctggagcatggcagattttaaggcagagaatgtgaaagaagagggaaaaccaaagtggtaccgaacattttatgcagatgagcagggagcgtggatcggcatccaggtcaagaagggtgtttatctgcttacattcggcggcaccagagagtgattcgtaatagatccatcacagttatgttacaaatttctccttggattttgttataatagacagacaagttgacaggaggaatggttatgagtataagatgcaagcagttgataggaatcttgatgtctgttgttctggcaatgggaagtcttttggttccggtttcagcaaaagaaaaaacagacattacggagctgctaaaaataaaaagcagagcagcgtacaacaagggcagaaaagcggcagggaaaaacaaggcagagattcatgtaaaaaagtatcgttctataggtgagatgtggccggagaacttttggaaacggcggacgaaccgctaaaaaactgaaaagggatgtgagaactgtacagaaaacaggacttacatccttttttgattttttttggaaaaattataaatccgctcaacgagtgaggggcccagaagaggaggcggcttgttcattttgctgttgagaaaattttcctgtcagtaaattttattgacttttttacataagtattatattataaagatgaacaaaataacaatatatgttcaaatgaacaaaaagaggtgatgacatggatatgcagagaagaactatgactatgatcagcaagctgtattatgaagaaaatatgacccagcagcagatcgcaaagcagaccggattgtccaggatgaaagtgtccaggattctccagaaggcaaaggaagaaggtatcgtaaggattatcatagattactccggcgtttatccggaactggaacaggacatcaaaggaaaatataagttaaaggatgtggtcatcgtagacacctccatcggaaattcttcaaaagaacaggtggcctccgccgcggcctattatctggaacggcatttggaagccggctctacagtcgccgtcgggtgggggtccacgatgcgtctgatcccggattatatacagaagatggatgatccggagctgttattttcaccaatcatcggcggacacggacagagcgaactggatatgcacgccacgaccatagcttccaacctggcaaaaagaacaggaggaagatcgctgtccctgattgctccagcacttgtgaaaaataaagaagagaaagcatttttgacagatgacaaccaggtaaaacgtgtaatcgagcgcacagcccaggcagaatatgcggttttcagccttggcaatccgctggcaaaggacagcagcatcaaaaagtcgggctacatttctgaggcagacttaagacagctggaaaaggaggatgccatctgtgacgttgtctccgttgtttttctggataagaacagccatatatgctgtgaaaatattactgagagatgcatagggatcaccgaggaacagttaaaaaggattcccaacaaaatctgtgtggtagagagtgaagaaaaatatgactccgtgagatccgcactggaggcaggatatatcgatatattgatcacggatcaggataccgcggagtatctgtccaaatgattttaaggaccggaaaaccggtctttaaaaataaattaagaaaggaggtggatgacatgaaggaataccatattttgatcgcctgcgggagcggtattgctaccagcacggtgattgccaaccgggtaaagaatctctgcgaggacaatggatttaaagtaaaagtacagcaggtgaaaattgtggaggtagaaaagatggcttcggaatttgacctcattgttgcaagcacgagagttcctgaaacagtaacgacaccgtcagtatttgccattaactatctgacagggatcaaaccggaagctgttgacgaacaaattcttaaggtcctgagggacctgggagaatgacgatgtatatggaggtaaagcatggaatatgtaacaatggcggaaggccttgagttttccagggtggtgcttggtttttggagacttttagactggaatctttcaactgatgaactgatccgctatctggaagaatgtctggatttggggattacgacgatggatcatgcggacatttacggggactacacggtcgaagagaaattcggggaagccatgaaaaaaaggccggatctcagagacaaaatgcagatcatttcaaagtgcggcattgtctacaagtcagaaactgcacgtgtcaagtattataactacggtacagactatatcatcggacaggtggagaaatctttgaaatatatgggactcgatcacctggacacattgctcctgcaccgtccgagtccgtttatggacccggaagagatcagcagggcgtttgaaatccttttaaaggaaggaaaagtaaggacctttggagtatctaattttctgccggacgaattccgtctgctgaaatcttatctcaccgtgcctttgatcaccaatcagatcgaactttctcctctcaggatgggaaatatggaaaacggagtcatgaatctttgtctggaggagagaattcacccgatgctctggtctccgcttgccggaggcaggatctttaccgggcagggagaagaggaaataaggctcagagaggttttagaagtcatccgggaggagatcggtgcggaggagatcgatgaagtggccttcgcatggctgttctcacatccggcaaagccgattccgatcacaggttcaggagaaatcggattggcagagaggccggtcaaagcgctgaaataccggctgacgccggaacagtggtttatggtctggacggcagtcaagggccacaaagtaccatagatgaatgagggtacaatgggaggaattgtatggaaatattaaattttatattgggattgggttccacagttatgctgccgatcattattttcgtgttcgggctcatcatgagggcaggattttcaaaatcatttaaatccggtgtgaccataggaatcggatttacagggatcaatctggtcattacactgttgacggatcagctgggcccggtggcacaggccatgacggaacgtctgggactggatcttcaggtcatcgacatcggatggccggcaatgtcatctatttcctgggcgtgggcagcggcaggtctgatgataccgatcggactcgtgattaatttcgtgatgctgacgctgaaacttacgaagaccatgaacgttgacatttggaactactggcagttcgctttcgtgggatatgcggtgacaaccgtgagcggaagcctgccgatgggaattattgcagccagtgcactgtccatcctcgcgctgattcttgcagattacacccagccttttgtggaaaagttcttcggcatgccgggcatttcatttccgcatttgacggcacttggatttctgccgctggtcgtgcctttaaactggctgatcgataagattccgggactcaataagctgaatgccaatccggagaccatcagaaaacggttcggcatctttggagaaccaatgtccatgggcttgatcatcggtcttgcacttgggattttgggaggacagaagattgacgcagttttaaaacttgccatcaccatggcagcggtcatgtatctcatgccaaagatggtagcgattctgatggaagggctgatcccgatctcagaggctgccagggagtttatggcaaagcatttcggggacagagaaatctttatcggactggatgccgcagtttctctgggagagccttctgtaattgctgtagggcttctgttggtgccgatcacgatactgctggctatcgtactgccgggcaataaactcctgccgtttgcggatctggcggttatcccgttcatcgtatgtctgatcactgccatgtcaaagggaaatgtcatccgggcgctgatcgtgggaacagtcgttatggcatgcgtattattgatggcaacaaatctggcaccgatcgagacgcagatggcattgactgcaggaatcaaaatgccggcgggagcttcccagatcggaaatcttgaccgcgcgaacctgatctcgtggctgttcgttaagatattctcgctgtttggctaaataacacattcattgattaaaggagaaagaagattatgaaaatgacaaaacaagaatttttaagcaaagtggaccactcattgttaaaacctcagctgaccagagaagagatcatggaaggacttcagtttgcaaaggagaatcactgtgcatctgtctgcattaatccgtgtaatctggatatggcaagagaagtactggagggtaccgatgtaaagatcggaacggtgatcggatttccctcaggggcacatacaacattttcaaaagtagcggaggcagtggatgcatatgccagaggggcagtggagcttgatatggtcattgacatcggggcactgaggaatggtgaatacgaggatgtaaaaaaggacatcgaggcagtggtcaatgcgacaccgggcatagtaaaagtcattcttgagaccgcatttcttaccaaagaagagatcaaaaaaggctgtgaactgacagaggaggcaggggccgcctacgtaaagacatccacaggatttgcaccttccggggctacggttgaagatatcaaactcatgaaagatactgtgtctgagaaggttcatgtaaaagccgccggagggatcaacaatcttgcagaatgtgtggcaatgattgaggcgggatctgaccggatcggcatcagcaaaacaaaagcgatcctggaagaattctaataggagcgtgatattatgagagagacatctttactgctggccgggggcatgaagaaagaaaaagcccaaaaggcggcagattttctgaaagaaggattaatagaaagggacataaaggccgaggtgacatttgtaaatacatatgaggtgacggacataaaaagtctggaagagggccatgatatggtgatctccacggcgacaggcagtctgaatacatcgcttccggtacttcagggactgtgtcttttatatccatggatggggacagggaaactgtatgaggaagtggaaaagaatcttgacggcagataaagggaggagacaggatggagcagattttcagagaagatttcatctggctggacgaagcatttgaggacagaaatcagttttttgaacagatcggagaaaggctttatgagcagggcaaagtcagagaaagttttgccgatgggctgaaaagcagggaagcagtttatcctacaggtctcaagaccgaagcatttgagattgcaattccgcatacggatgtggaacatgtaaaagaggcatccatatcttttgtaagatttaaagagacggttttgttttcgcacatgggagatcctgaaatccaggtgaacgcaaaatttgcttttgttctgggcgtcaaagagccgagtcagcaggtagaggtgctgagtactctggttttgctgatctccaatgaagaagaaatggcaaagcttgaagttctggattcaccggcgcagatctgtgcactgctgaatgaattttttaaagagcatatgcagaaagggttaaaatgatggatatacagcacagaaagaaaaaagaaacactcatagacagtcttcatttggggcgaagcgtcggcagagcatttctttcttatggatgtattatatcataaccgtacactattttccagggacttgcggcgcaggtccctgatatgtttcatctatgggagatggggacaatcaatccctgtctcgatttttccacgaaaaaagcaggaaccgggctggtcatttcttccgagattcatcacaaagcagcgaatgcctgagaaatggccggtacagtgcaaaaggatatgtgccgtcagaggatgaactgataaggaaatgctttgcaggcagaggattgaatgatattataaaggtatgatttttatgagtcagtgattcagggataaggaaagggaaattatgaggacagggaaatattgcagggaatgtctgcttcggagcgaagagcggaaagtggaacaggagcagaactgggagaagaaacagctgtttcttgaccaggtgcgggcagctttaagagatgaggatctggaactgtctccgccggaatatctggctgagtttacagaactgtatgagcggcactttggggcgcagacagcctttgatccgctcaaacggcattttaatgaactgatgcttaaaaaagagccggagatcagaaaaaggatcgaggcgtctgaagatccggtagctacagcgattcaggcggcacaggcggggaattacatagactatatcgctctgggcgaaattgacggggaccagctggaacagctcttgtttcaaaatggagaaaaagggctgaagcctgaggtttacgattcttttaaggcagatctcagttctgcaaaaaaccttgtctatattacagataactgcggtgagattgtggtggataaggttttgatccaggaactgaaaaaattttatcctcaggttgatgtcacagtgatcgttcgtggagcgggtgtggcaaatgatgcgtccatggaggatgcagtacaggtgggtctctccgacgaggccagggtgatcggaaacggtacgaggatcgcagggaccagcttaaacaggatcagcagggaagcaaaagaaatcattggcagagccgacgtgatcatagcgaaaggacagggaaattatgaaaccttatccggatgcgggctgaatgtatattatcttttcttatgcaaatgcgactattttgtcaaacggtttgagggggaatatcttcagcatatgtttataaaggaaatgtaaaaaaaatttcaaaagctccataataaatagtatcccgccgaggcagggtactatttttataacagaggaaagttctgggacccttcctctgccataaaaattctccggtgggatcgcactgcggcgcatagggaaattgctgccttatggcagccaacgcaggcgcaaagtttcgtttacgaaactctatttcatatggaggtgagttttatggcatcaaatatttatggttatgcccgtgtgtcaactaaggaccaaaatgagagcagacagcttcttgcactggaagcgtttggagtggagagaaagaatatttatttggacaaattgagcggaaaaaactttgacaggcccagctacaggaaactgacaaaaatactgagggaaggagacgtactggtgatccagagcatagacaggctggggcggaactacggcgaaattctggagcagtggagggtcgtcacgaaagagaccaaagccgatatcgtcgttctagatatgccgcttttggatacaagaaagaaacaggatgatctcacaggcacatttatagccgatctggtacttcagattttaagctatgtggcccagacagaacgggaaaatataaagaaacgccaacaggaaggaatcagggcggccaaactgagaggtgttcattttgggaggccgaggaaaccgataccggagaaattttatgagttaaaagaacagtggaaacgcggtgaaatttcatcacggaaagccgctgcacagcttcagattgcccaggatacatttcttaggtgggcgagaggacagaagtaaaagaaatagtagacattatcattcaatccattttgtacataaaactgcaaaaaatattcatatatttaagagataaattcatttcttacagtatacattaagcgaacgaaaaagtctgctttatcgttctttggaggtaagatatgatacagaagaaaaaagatttcaggaacaggcttttagaatatctggcagaggaggcgggctgtcaggacttgtccgatctgcccaccggtttttggttcccggtggcatgttttattgccggttccgttaaggctgaacgttacagcgtgagggaatggaatgaggctgtcagatatctgacaggggagaatatccggtttgcttctcccatacaggcacagcaatttctggaagtaaataaggacaatttttatacggataacaaggccggaaaaaggatgtaatgtctgttgcagatagatgttgtatgggttaagatattgtagaaagaaaacaaaaagtatcactcatataatatccaggaggttttatgaaatcatacagagaagtactgcattttcatctgccgtccaggcgggggattgtgaatattacggataaggtccaggctgctgtggataaaagcggcataaaagaaggcatggtgttagtaaatgccatgaatatcacagccagtgtatttattaatgacgatgagtccgggcttcaccatgactatgagaaatggctggaaaaactggcccctgaaaaaccatacagccagtatcagcataatggatttgaggacaatgcggatgcccatctgaaacggacggtcatgggcagggaatctgttgtggcaattactgaaggtgatctggattttggcacatgggaacagattttttattttgagttcgacggcaaacgggacaagcgtgtactgatcaagattattggagaatgatatggagaacccgtggatcagaacagagctgcttttgggagaagaggcagtagaacaattaaaaaagtcccatgtggctgtattcggagtcgggggagtgggaggctatgtggtggaggcattggcaaggacgggtgtcggcacttttgacctgatcgacagagatacggtttccgtttccaatatcaaccgtcagatcatcgccacacacagtactgtcggtaaagtcaaagtggaagtgatgaaagacaggatcctggagatcaatccggaagcaaaggtgaacattcataagtgcttctttctgccggaaaatgcaggggagtttgatttcagccgttattcttatgttgtggatgcagtagatacggtaactgcaaagattgagcttgtgatgcaggcccggaaagccggagtcccgatcataagcagtatgggggcgggcaataagctggacccgacaaaatttgaggtgacggatatctataagacatccgtctgccctctggcaaaggttatgcgaaaggaattgaaaaaacggggtgtaaaaaatctgaaggtagtatactctacagaaaaagccctgcagcctggagttgatctgtccggggaagaaggcagaagagcggtgccgggaagcgtggcgtttgtgccttctgtggcaggactgatcgcagcaggggaagtcatcaaggatctgatcactaaataaagcagcaggatgattgatgtatactgtggattatttagtgaagtaacagaaaggatccctgcacatttgttttcttgacggatcttaaggaaatgatctaaaatatctttgaatgagtccaagagataaaggagaaataaaatgaagccgggaataaaagatgtggcaaaagttgcgggagtttcaccaaccaccgtttccagagtgctgaatgaccgggggtatatcagcgaagagacgagaaagaaagtttaccgggctatgaaaacgattgactatactccaaatgaaatagccagggcactgttgaataaccgaacgtacctggtgggtgtcatcgttccatcaatctccagtcctttccacggccaggttgtacaatatgttgagcagtttcttgcaaaggacaattacaaaacattgctgtgcaacagcaaaaacaggtcggatacggaaaaagaatatgtcagtatgctgaggcggaaccaggtggacggcatcattgtgggaacccataatgaaaatttaaaggagtatgaggaggctaaacttccaattgtggccattgaccgttacattgcaaaagatgtggcaacagtttcctgcgacaattacattgcagggaagatcgctactgaacggctcattgcgaaaggctgccgtcatattttgtgtatccgtggaaacagccggcttaagatgcctggaaacgacagaagccgcgcatatatggaaacgatgaaaagatatcactatgaaccgctgatcatggaagtggaatttataaaaacaattgaggaaaagaagaagctggtcagcgaaatgttggagaaacatccggagatcgacggagtctttgctggtgatgatacactggcagtgcttgtattaaacctggccagggaaaagggaatccagatacccaaggatatgaaagtgatcggggtggacggcgcagagcagacactcagtatggtgccggagctaacaacggtccagcagcctattgaagccattgcaagggtgacggtccagacgctgatcgatcagattgaagggaaagaagtggagagtcatacggatcttcctgttcggctgattgagggtactacggcgtaaacagatatggtaaaaaacgaaagaaagttctcagggactttcttttttttgttggatatcaccaaatctgcaatggaaattttatttaaagtgacagtatggtaacgattgacatataataagtcataaaaaggggaaaaggaggagcagccatgcacaagctttactaccagccagagggtgtatgggtgggtgatatcatgccatacgccgaagatggagaattttttgtctaccaccagagagatacccgggatccggtgccatttggtcagccgtttggatgggcattggcaaagactgaggactttgtgaagtataaagatttgggagaaagtctgaaaagaggatctgatacagacccggaccagtttatctatgcgggaagcgtgtttcgttcaggcgggaagtttcatgcgttttatacgggttacgtgggaaaaatcaaaagggatcttaaaacttccgccccaggagggatatgacaggagaaactggagagatccgtttgtactatgggatgaaaataaaggtgagtatctgctgatccttggtgccagaaagggtgaggataaaagaaaacagacgggacgcctggtaaagtttacatccagagatctggaggagtggtcatttgaaggagataatgataagaactcttacctctggggagggacctttgtacctcatgagctttaccagagagaagatgggacactgggagcaaaaccagtggattctctgtggaatgcgtttaaggaatgggaaaatttctctgggttttgtgtgaaaacgattgacacgaaaacagaaaagatcataatcggagacacaggagatctgatggcttttgagacaaccattagatttgcggaaggcaccagagctttttcgctgaaattctatgaagatccggaaagcggaactgcttatgaatatagatttctcatagaagaaaacagagtggtgtttgataagtctccaaactatccatggtatcagtgttttaatattggcctggagcgtccgattcttttggaggcagagaaggaatataagatccggcttatcgtggatgatacgatcggcactttgtatattaatggaacggcactcaacgccagattttatgacaaaccgggtactgcattgggaatgacggtgacagacggtacattctactgtaaggatacaaagatttcaaagaaagtaaagaaagagaggtaacagatatggattatcagaagacggcccgggatgtggcagaactgatcggcagtgcgcagaatatagatggtgctactcactgtgtgacaagattgagactgattttaaaagatagcacagcatatgacaggaaggctctggagaagattgaaggggtgaaaggtgtcatgttcaacagcggtcagctgcagatcatttttggagcgggaacagtgaataaggtatatgatgaatttatcagactgacaggggctaaagaagtgactgtggcggatgccaagaaacaggccgtgagcaagatgggaaaacttcagcagggcttcaaagtcttttcagacatttttatccccatcattccggcctttgtggcggcagcgatcattattggaataaaatcactgcttttggcagacggtctattcggtataacaggaagtctggctgacaaaagtgtgttgctggcaaacatggccgatttctttggaattatagccaccacctttgattatctgccgattcttgttatgtacagtgcagtaaaacggttcggcggcaatccggtccttggtatcctggttggaattgttatggttcatccggagctgttaaaccggaatgtctttgcattgacgccggagaaggccgattattggaatttcctcggactttctgtgccgagagtggctttccagggaggtgtgttcccggcaatcctgaccgcatggtttatgtccaaggttgaaaagatcgcacagaaatatgtaccggaagtagtttcttttgtattagtaccgacaatcactattctattggcaaatattgcactttttaccgtattcgggccggtgggcaacgtgattggaagtgtgctggcaggaatcattgatgtcctttataaccgtttaggcgctctgggagcttttgtgttcgcagctatgctccagccgctggttgtcacaggaactcaccaggcaatccagggaattgaggctaatcttgtagccaccaccggatataactatatccaggcaatctggtctgtctctatcattgctcagggcggcggagctattggaatgtatttgctggcaaagaaaaaatcaaaagaccgtgatatcgcaatgtccagttttgtaccgactttggtaggaatttcagaacctgcaatcttcgcggtcaatatgaagtattccatcattccattcatctgttcctgtctgggagcgggaatgggaggtgcttttatgaagctgatgtccgtgagagcaatcggacagggactgaccggagtattgggaatgctgatcgtagtgccggataaacttctcatgtatgtaataggcaacctgatcgcatttgttgtgccgattggattaatcctgctttatgacaagagtaaaggggtgcccagagaagaacaggaagaggagaatgaggaaacggaggaagaagtgcctgctttcgcacagaactctgcagaggcggaagttcatgcagtttttgcagtgacagacgggaccgtgattccggtggaagaagtcaacgacggggtgttttctgaaaaaatcctgggtgacggaatcggaatacgtcctgagggagaaacggtaaaagctccggccgatggtgagatttgtactgttatggaaggaacaaatcatgcggtaggaataagacttgctaatggctttgtatttctgatccacgtgggaattgaaacagtatccatgaacggcgatgggttcacctgttacgtgaaggtaggggatcaggtcaaaaaaggacagagactgctgacatttgataagaaaaagattgagaaaaacgggcttgatccaacagtcatcgtagtagcaacagaagagggaacaccgatgccgataaaatttaagaccggacagaaagtaagtgctggtacggatgttattggagaatggtagagctatggaatttttgaatatagaaaagtatacatatctggaagaaaaacaccgcggttatttggaccagctgaaagacttctgtaaaaaaagcccgcgtcttccacgatatcatattcatccgccgtgcgggttgctgaatgatcccaatggcctctgttactttgaagggaaatatcatgttttttatcaatggtttccgtttgccccgaaacatgggatgaaacactgggcccatgtgatttctgaagatcttgtacactgggaatggtctgaggagatgcttgtgccggatcacgagtttgaaaaaaacgggtgttattcgggaaattctattgaggctggaggaaaacagtatctgttttatacagccaactataagaccaaacagggaaaggtgccgaaacaggcattggccgtaatggaaaaagacggaaaaattcataaatattcgggtaatcccgtcatagacggagcaccggaaggaatgtcaggagagatccgtgacccgtttgtatttgagaaagacgatagttattatatgatgcttggaggttcagatcttgacggaaccggacagattttaatttataaaagtgcggatctcttaagctgggactataggggaaatctggatcttggtaggcaggatcttggcacaatgtttgaatgccctgcgtacatggaaattgatggaaaggatgtacttcttttatctctgatcggccgcgcagcccaggaagaacgttttcagaatgaattcagcacagtatgttttactggcagaattgatcttgaaaagcttacatttgaaacggaaactatggaagaactggataagggatttgatttttatgctcctcagatgttttgcggcaaaggcggaaggccgctgatgtttggctggttcgggtgcggagtacaggaactgccgtatttcagggaagatatgtggcagcatgctttgactctgccaagagaaatttgtattaaagacggcagactgtatcagatgcctgcacaggaaataatttcacagttttctgcattggacataaagagaggtcaaattattatcccggaagaaaatgcatggagacttcatctcatatctgatacagaatgcaaaacagaaattcatattggggaatcgtatgatcatttgaagattgttatggacccaatcaaaggacaattcattgctgaccggagctgtctgaaacaaaagatcagtgaggaatatgggacacgaagggtctgtcctctggatacacataaatctgttgaagttgatctgtattatgataatacatttttagagatttatattgatggaggaaaggacgttatgtcactgcggctgtttcctgagtcatataaagttgaaatgatataaagatttaaagataaaagaagtctctcgcttttaggctgagacttctttttttcacgatttatagaattccgataatactctgtatcccaaggcttaccacagagatggcaacccagcagcaaaatcccataaagattggcttaccgccagtttttacaagtttgacgatatgagtattcagcccaatagcggacattgccataacgataaaaaatttgcttaaagtttttaaaggatctgtcacagctacaggcagggaaaacacagttgtgatgacagaggcaaggatgaaaaacaatacaaatattggaaagacctgctttaggctgaaattggagccgctttcttccaaagtcttctcttttttctctgcacggaaaatcgcaagcgccagggtgatcggaataattgctaaagttcatgtaagttttacaatagtaacaacattcagagtattgctgccatgaattccatcccatgctgcagcggtggcagtgacggaggatgtgtcgttgacggctgtgcctgcgaacaggccaaagcctccattggacaggtgaagtatatttccgagtgctggaaatataagggcagcaatcacgttgaacagaaagatgacggagatagattgtgcaatctcttcgtcatcggcttcgatcacaggtgcagtggctgctgtcctttttccaggatatcggtaagattcatgccgaatccaaggaggatgaccgcatactgcaaaattttcttcgaggtaaaggcaatcccgggcttcatagatcatataataagataatttaatgatttttgattcaaaataaaaaatatatatacatttatcataattgctattgaataaagcattcatatatgttaatctaactgtatgcttagtcaaaaaatataaaggagatgcatttaagtgagtggagcaaaactaacagaagcagaatcagtagtaatgagatgtatttggaattatgagaaagaagagatcccgtttttgacattaatagaagagctgaaggataagtatggtaaggattacaagaggacaaccgtacgtacatttctttttgatctggaagcaaagggatatgcggtggttgagagacggggaaaattttcctatgtgaagccggttgtcaaaaaagatgactacaagaaagtcaaggcagaagaggtattggatatctggtttgacggatcagcaaaaaactttatcagtgctctcagcgagagaatatccggggacgagcaccaaaaactgaagaagctgctggacgaattggatgcagattgatctgacagagtattggaaacgggaaaagttcagccgggagaggagagacattctgatttgcagggatgtctttttcgttatataaacttgtccattctgtcccagacataaaagacaaaggagaacgatatgctggattttaggatttttacatttcttgaagtatgtaaacagatgaattttacaaaggcagctaaaaaactgaatatcacacagcctgcggtgtcacagcatataagatggcttgaaaaggaatacgggataaagctgtttgagatggaagggaaaaagctgagtcttaccgaaaaaggagatctgttccggaatgcggctatgacatttcagcacgatgagatgtacttaaaacataaaatacaggaaatgaaaaagggaaaacgcaggttttatttcggagcgaccttgacgatcggagattttattcttccccatgcagcggctgaatttattaaaatgcatcccgacacagaaatttcaataaggattgcaaatacagaggatctcttaaaccagctggatcagggtgagattgattttgccatggttgagggatattttgaaaagaaggaatatgattaccgcatatattccagggaatcctatattgctgtctgcggcagagactattgttttcaaaaggaaccggaggtgctggagaacctgctctctgaacctttgataacgagggaggcgggatcaggtacgagagagattatggaaaaaagtctggagggaaggaacttaaagatcggagattttaagaaaaatcatgaggccagcagtctgcatatgataaaaaaactggtggctgaagggtgcgggattaccttcctgtatgaggcagccgcaagagaagaattaagagacggtatactgagaaaactggaattgaaagattttccggtagttcatgattttacattcgtgtggaggtatcatagcattttttcacaagattaccttgatatattcaacagtttgcacaaagatgatgaatatacaatataaatagacaataaattaacgaaagctgttgacacaactttcacaaagtgatactattagctcacaaatatttagcttacaaagtattggcgggctaatagtagggatgctaataagttttatgtaaaagcaaacaggaggaaaaagaaaatggttgaatttaaattgacaaaagaacagctgcttgcacagcagatgttcaaagatttcgcagagacagaaatcaaaccaattgccagggatatggatgaaacagaagaattcagcatggatctgcttgaaaaaatgaaaaaattcggtattatgggaattccatattccaaagaatacggcggagagggtgccgatgtcttaacatatacactttgtatggaagagatgtctaaagtagatgcctctacaggaatcacgatttccgtacatacatcgctatgctgttcctgtatcaatgactttgcttccgaagagcagaaacagaaattccttcgtcctctggttgacggatctaaagtaggatgcttcggccttacagagcctggagcgggtacggatgccagcggtgtgaagacaagtgctgtgctggacggtgaccattatgtattaaacggacagaaagtatttactacaaactcaggttttgccgatacttttatcatttttgcaatgacagataagagtgcgggaacaagaggaatgtctgcatttattgttgacagaaacacaccgggattagaggtcagcaaaaatattcctcgtatgggtatccgtgctgcatctaactgtgaagttgcgctggttgatgtgagggttccgaaagagaatgtgatcgcaggtgaaggaaaaggatataagatcgcgatgtcggcactggcaggcggacgtatcggaatcggagctcagtctgttggtattgcacagggtgcgttagatgaggcgatcaaatatgtaaaagaaagaaaacagtttgggaaaccgatttctaaatttcagaatacacagttcctgatcgcagaactccaggtgaaaattgacgctgcccgccttatggtatggagagcggcaaaggccaaagacgatcatgaaaattatgctccgctggcagcatcctgcaaattgtttgcatctgatgtggcagtggaagtgacaagagcggctgtacagctccttgggggatatggatactccagagaatatccggtagaaagaatgtaccgtgacgccaagatcacagagatctacgaaggtacatctgaggctatgaagatgatcgtaggcggcggattgttaagataagcttaaagcggaaggagaataaagagatgaaaatcgttgtttgtgcaaaacaagtaccagatacaactgaagtaaaattagatccaaagacaaataccctgatcagagacggtgtacctagtatcatcaatccggatgataaagcggggatcgaagctgccctgcagttaaaagaaaaatgcccgggaagcactgtgaccgttgtttccatgggaccgcctcaggcagatgtggcattaagagaagcacttgctatgggatgtgatgatgcagttcttgtttctgacagagctttcggaggagcagatacatgggcaacctcttctacgatcgcagcggctatcaaaaaattagattttgatgtgattatcacaggacgtcaggcaatcgacggagataccgcacaggtaggtcctcagatcgcagaacatcttggtattcctcaggtcagctatgtggaagatttaaatgtggaaggggaggacactctgatcgttcagagacagtttgaagaccgtcatcagatcattgaagtaaagactccttgtctgatcacagctttggctgaactggctgatcccagatatatgacggtacacggtgcatttgatgcctacagagaaaaagaagtaaaagtctgggggcttgcagacttagaagataccatagaccaggcaaacattggattaaagggatctcctacaagagtaaagaaatcttttacaaaacaggccaaaggtgcgggaaccattttaaaagatttatcagcagacgaagcagtggcatctattgttggtaaacttcaggaaaagcacatcatttaagcaaggaggagaattaaaaatgagcagagacgtatacgtattcgctgaacagagagacggcgaacttcagaaagtcggaatcgaattagttggcaaagcaagagaactggcagacgaccttggacagcaggttgctgcagttctgcttgggtcaggcgtgaaagataaagcgcaggaactgattgcctgcggagcagataaagtcgttgttgtagatgatgttatgctgaaagagtatgtcacagagccgtatacgaaggcactgacagccgtgatcaatgcaaaagatcccgagatcgtgctttatggggcatcttccatcggacgagaccttgcgccgagagtatccgcaagaattcacacaggactgacagcagactgtactgcactcgagattgatgaggagacaaagcttcttatgatgacccgtccggcatttggcggaaatatcatggcaacgatcgtgtgtgaagacttccgtcctcagatggcaacggtccgtccgggtgttatgaaagcgttggaaagcgatgcatccagaagtggtgaggttgaagaattcaaggtggaattctctgctgcagacatgaatgtaaaagtacgcgagactgtaaagacagctcataaatctgtagacatcacagaggcgaagattcttgtttccggaggacgaggaatcggaagcgcagataagttcaagatgttagaagaacttgccgatgttatggaaggcgaagtatcctcttccagagcctgtgtggattctggatggatcagtgctgaccgccaggtagggcagacaggaaagactgttcgtccggaattatatctggcctgcggtatatcaggagccatccagcacgcagcaggcatggaaaactctgaatttatcgtagctatcaaccgagatgaagatgctccgatctttgacattgcggatcttggaatcgtaggagatttaaatactatcgtgccgaagcttacggaagcggttaaggctttgaaagctaaataagatatatagaaagaataattatatataatatagggaagaaggagaatagcagattattttccttctttttgtttgttttagccgagggataaaataaaaaatagattgttttatttgaaatagaagatatcaagggatattaaaactatcgaaaagcatattagtaaaggattatcaaagcaattattttaccaatatgattgtttatgaaatacaaaaagaagatatgtctagtgctagaactagaatatattcggacattaatttacattagtgttttgccagcgtttgatactaaccagatgaaagagtatcaacatctaaagaataagcttaacgagatactattgattgaaaactaattcttgtaattaaaggattttcttcagaagcatgcgaagtgaccgctaaaatatgacaattatacaaaaagccatatcagcggtggactctttaagttaaaaggtgccaaagtccactttatgtgaccgattctgtccgtgatctgcgttgactttgaacaacagaaaaattatctttggatattgtcttcaagaacctatatgtagaggttccgcttgtgaagataaagtgatataataattggcaatgagttttgttctgatgtaaagcaatgagagtacaattatgggaatgtaaggagtatgatgaaagaattgttcatcttgcgctggattgtattgccatccacttggattatggtattaaagccaattaccgtaaggtgtagataggatctgatgggaagttctacgaagtgttggccgactcaaaatccattatgaccaagaaatgacgaggaggtgtcctatgggatataggttttatccagcgttgatcacagcagcgattgtcctaataggacatgtcttaaaatggacttcactgctcgaatataagaagcgaagagatgaaacgatagaattctcaaatagattcatagaattggcaaattactatatcgaacactgttcgattgagcctgagttgtatgctgtttgcattcatgatgttgataaaatccaaaaggagttggggaacgatggtgtactagctgagtttgttgatccattcaaacaaatcaaggggagaaactatcaactgttcatgaatatactccctgagatgcgttccatggtaaaccagcttgacagtataatgattcgagagcgaataggtcaattgccaggcttgtgtgatgatgctcttagaaggcatgttggcaatttagacagggtgattgaacaagaaaaaaagagtattttgaatccattcttatgttttggaagtggaattctcttacactaattggtttgcttagctcaattattactattgcccttgggtgggacggatttatagacattttgcacagttttatttctaaaatttgagtataatactttgaatagaacaggaggtgtgaccaatgacagcagaagagatttttgccggtgaatccgacaatgtggaattcaaagaagaaatcccggtaaaaagcgaaaggtatatgaagactgttgtggcctttgccaacggcagaggcggcaagctgatctttggtgtggaaaacaacacttggaaagtcaccggtttttcaaaagaagaggtttttcaaaaaatggatgccatcaccaatgccatttttgacagctgtgaaccgaaaatcatacccagtatcggtgtgcaggaagttgatgggaaatccattattgaagtggaaatcatgtccggtatgacgcgtccttactatatcaagagccaaggtcttttggatgggacgtatgtccgggtgagcggtacgacacgtcatgcagaacgttatcaggtgcaggagctgattctggaaggccagaaccgttattatgactgcgaaccctgtgaaggactagctgtcacttctgaggacattgccattctgtgttccaatatgaaagcaatggcgctgcgaaacactctgactgatgcagagaaggcaaaggtcaaagaccttacgcaaaacgttctgatttcttggggcgttttgatagaaaaggatggggcagctgttccgaccaatgcctatgcgctgctgacagggcaggcacatgagcagccaattattcaatgtgctgttttcaagggaactgacagagcgtattttgtagaccgccgagagtttgaaggctccattcaggatcagatggaagcagcgttccagtacgtgcaggagaaaatcaaccgtggtatgaaaatccaaggaatgtaccggcaggacgtttacgaactgcctttggacagtgtgcgtgagttgatcgcaaattctgttgcccaccgcagctacttggaatcgggcaatattcaaatcgctttgttcgatgaccggctggaggtcacttctcccggtatgctgctgaacggtgtttccattgccaagatgaaggaaggctattctaagattagaaacagagctattgccaatgcattttcctacatgaagattattgaaaaatggggcagcggcattcctcgtattattcgagaatgcaatgaatatggcttgcctgagccggagttttttgattttgatggagacttccgggtgaatatgtatcggaaagccgccccaaataccaatttggaaatgatgaaagaggattcggcacaattcggaaatccggcacaatccggcactgccagaatgccggatcaagaaattgcaatagtcggatttgtaaaaagcaatggcagctgtacgacttcacaagtggccgagctgcttttggtaaaagatagacgagcaagagttattcttggaagccttgtaaaaaagaacatcttaaagaagagtggaaacgcaagaaacacgatgtatcttgcgggtgaacagttcccggaatgaaagtgataacatggcagagttgaacctaaatcagataattgaaaagctgaacgataattttacgggagatatctgtaagatcgttttttgatataatggtaaagcagattcaactgagtaaattgattttgtggaacgagaggatacacctataaacaaccctggcacaggctaataaaagcttttaaggaaaatgatatataaatgagagatcgggcaggaaggaaaatgaaatcattcccttcctgcccgatttctttgcttattactatatgagagattgttgatattattattgacaatgctcaataataatgctaaaatcaacttaaaatataatcaaaatatgatcaaaatataatcatgatggttggggagtgtaatatgaacagaaaaaaacgcaatacaatgatggcttttggagcctttgccatattatttaccggatatcctcatgtctggtctatctaccagccatatgtgatgaaatcggcaggatggagcacggggcaggcctccatatgcttttatctgccgaccatgttttttgtactgggaaatattttagggggcaggcttcaggataaaaaggggccgactcccgctgtgtttatcgggggaacagtcttaacttcaggagtgctgttgtccagatacatgctcctgccgtcacccgtttggatgtacctgacgttcggagtcatgcagggcatcgggtcaggaatgatctacgcaccgatcctttcaacggctcaaaagtggtttccgggaagaacagggtttgcatccggcgttgtgatcacggcaaacggaatctgcggccttttgatggcaccggtgagcaaaacactattggaggccggaggccctcagctggcatttttggccgtgggattactgattggagtctcatggattctgggaacattgttcatcaggaaaccagaggaaacagcaaaagagaagatgccggtatcttacggggaaacacgtcagtacacctcagcagagatggtaaagaccagaaaattttattacctgttatgcacgatgatgtgcggacttatggcatattatctcacatcgccgttatcgcagacactgcagacggacagaggcatcagcgcagccctcgcagtgggttcggtcatggcaggttccatattgaatgcagggatgaggctggtgctcccgtctctttcagataaaatcggcaggatacagtgcatcaaaggtgtgctcctgctctctatggcagctatggtgtttctcataacgggacagaagatattgacaactctggcagtgatcctgatctatggatgcttcggagggataatgggaagttttccttccctggcaagctctatcttcgggctgagacattccggacagaattatggaatcgttatgtttgggattgtcgtcgtgacggcactgtctccatgcattacaaacttaattgcggcagggcagtatccggtgaatacgacatttttaatcggctttgtattttcagcagcggcatttctgtttttaaccaggctggaaaaagaaattaagaatgaaaaacaggaaaacgggaaacagaggctggaaccacagataaaattacagttgaaatgatattaagagaaaggaagtatcaattatggcattagtgaaaatgaaacaattactggagcaggcaaaagaagaaaacagaggatgcggcgcgttcagtgttggaaatatggagatggtcaaaggggccgtcaaagctgcagaagagatgaatacatcaatcatcctccaaatcgcagaagtgcgtttggaacattctcccctgcacttaatgggcccgatgatggtccgggccgcaaaggaagcaaaggtggatgtggcggttcatttagatcacggtcttacactggagactgtaaaaaaagcactggaattaggatttacttctgtcatgctggatgcttcccgagatccgtttgaagaaaatataagaaagacaaaagaagtagtggaactggcagctcaatatggagcaactgtggaggccgaattagggcttgtaggcggaagcgaagatggaaagagtgatcacgggattcagtgtaccaatccgcaggatgcaaaaatattctgtgaacagaccggtgtagatgctctggcagtggccataggaaatgcacacggtgattatccggtggcgccgacgctggaatttggtgttttagaagaaatccgcaatattaccaagaaacctctggtacttcacggcggaagcggaattacagatgacggcttcagaaaagctatctctcttggaatctgcaaagtcaacattgcaacggcaagttttaacagcctgacaaaagaagtagaaaaatacatagggtctgaaggaaaacataattattttgacatgaatgaagctatggtaaaaggtgtctatgacaacgtaaaacgtcatattgagatctttaactgcaagtaaaggtattccaaattatattttgttaaaaggagaagcgcaccggcttattttaccggagcatttctcctttttaataatatttttgttttgaggtaagagaagaggaatttaaaatagtgtcatagcagccgttaaagacaaacgatggcgggagaaagctggagattattaaatattcagcagagtatgatataatgatatcaacaatgcgtgcacgagaacgcgagaggagaaagagtatggcagttacgattcagcagattgcagacctggccggggtatccaggggtacggtggaccgggcattaaataaccggggaagaatccggccggaagtggcagaaaggatcaaagggatcgcaaaggaacttggatatcagcccaatatggcggcaaaggcactttccaccgccaatcacgcacttcagattggagttatcattcagtacgcagagactccgtttatgaaggcagtgctggaaggcacggaattcgcgaaggaagaagtcgaacgcttcggaggacatgtatttgtggagtgcattcacggtggggacgtaaagaagctgctcaagacaatgaaagatttcagggaagccggggtgaaggggatcgctttggttcccaccgacgatgaactgctcaaaaagacgatcaatgagtttgtggaaaaggacaggatttcaatcattacgatcaactctgacctggaggatacaaagaggctctgcttcatcgggcaggactcctatgccagcggcagagtggccggaggactcatgggggagattatccccggagacgggaaggttatgatcctgtccggctctcaggaaaatgtagccactatggagcgtacaagaggatttttggatgaactggagcaccattattcaaggataaaggtcctggagccaagatatgcatatgatgacgactgggttgccgggaagctcctgaaagaacagctggaagagactccggatctggcaggcatctatatcacggcgcagggggagagcggggtctgcgatacattaaaaaaatacaggctggaaaagaagatcaaagtgatcgcccatgactatgagggagaaaaccgtgaaaatctcaaaaaaggaatcattaatttcatcctgagacaaaattcctatgttcaggggtatgagtctgtcatggaactattccatacactctgcggcaatccaacgagacagggagagttttggcacacagatattgtaattaaaacaagatgcaatctttgattgttacaaaaatataataataatattatcataatataatcattttaaattttctgtttatacagaatgtataaataaaaatacaatatcggactgcgatattgtatttttttgtgcaaaaaggatagtataagtgaaattatttaaaaaataattggaattattgtgtatgttgctgattgcgtgcacgcgcacgcaatgttatcataagttcacaataaaaaacaacaaatcaacgaacatatggaggtagagtaatgttaaatgtaggtgtaattggatgcggcggaatgggaaaagatcatatcaaacgtctcacaaacaagatccagggagcaaacgtagtggcagtttctgatgtctttgaagaaggagcaaaagaagcagcggcattggccggaggagctaaggtatatacagacggaaaagatctgattaatgatcctgatgtagacgcggtatttattgtatccccgggttttgcccacacagactctctgcttcaggctattgaagcgggaaaacgtgttttctgtgaaaaaccgctggcaacgacggcagaggactgcaaaaaggttgtggatgcagaagctgcttcaggaaaacatctgatccagcttggatttatgagaagatatgataagggatatgtacaggtaaaggaggcgctccagtccggagagtatggtgaaccgctgatccttcactgcacacacaggaatccagaagtgggaaccaattataatacgccgatggcagtccatgacacagcaatccacgagatcgacacacttcactggttagtagacgatgaatatgagagtgcacaggtgatcatgccgaaagtgacaaaatattcccactcagaattgaaagatcctcagatcatgctgctccgcacaaagagaggaatctgcatcgacgtagaagtattcgtcaactgcaagttcggatatgacatcaactgcgaagtggtatgtgaagacggtgcgatcaagatggctgaaccttcttacccgagcatcaggaagaatgcggcagtttcaacagccattgacacggactgctttgtaagatttgaagatgcatatgacacagaagtccagaactgggtagactgtgccgggcagggagtgatcagcggacctactgcatgggacggatacctggcggctgtgacagcagacgcattggtaaaagcacaggagacaggacagattgaaccgatcgtgacagcagaaaaacctgaattctataaataaatcggagaatctgccataggatcattacataaatcaggaggaaatagatatgaaaattggatttaatgaagcaacagcactggaatgtaaaggacagtctctgatggctgatctggaagcctgtgaaaaatacggatttgattacatagagatcagatttgactgcataaaggattatctgaaagaacacacgctggaagaactggctgactggtttaaaaatcaccatttaaaaccttgggcttacaataccttgatcttttttaaccagagagacgaaaaaggagtgcaagaaattgatgaagaaacagattttatcatcgaagtctgcaaagccatcggcatgaagatgctgatcacggttccttcatttgatgtcaaagacaagagtatttcagagatcaaagaagaagcagtggaacgcctccgctacttatcagacaaagtcggagaagacattaaaatttcactggaattctgtggtgcgccgaactgttccattaaccagttcggaactgcttatgatgtagtgaaagccacagaccgcgacaacgtgggcattacagtggatacgttccatttccatgagatgtgttctgaattagaagatttggaagcggcagacggaaagaaaatttttgcttatcatttaaatgactgtgaagacctgcctcttggttcctgcggcgatgacaaacgcctgtggcccggagaaggcgtggtagaccatgcggggatagcagcggccttaaagaagatcggatttgacggagtatgtactattgaagaattccgtccggagtattatgaaatgtcccatgacgagaacgtaaagaaatctgctgaagtgacaagggattttgtagcaaaatactttgcataaagcataagggggacaaagatgtctatgagtgaacaagcaataaagatgactatgaacgtggaagaaaattttgaggagctggaaggggagtttgccagggtaaagctttctgaaaaactggcatactgtgtgggcgatcctgcgctgacggttgtatatactctggcgaacactctgctggtttacttctatacaaatgtaatcggactctcagcaggagtcataggaatgatcatgttggcgtccagagcatttgacggtgtatccgatgttatcatgggaacgatcattgaccggactcattccaagtacggaaagtccagagtatggatcttgcggctggtcattccttatgccattgctgcggtactgctgatgacagtcccgcagggtacaaaaacagtgcaggcagcctatgtgttcattacatataacttacttaacaccgtaatgtataccggaattagtcagccgttccatacactcggttccctgatgagccgtgataagcatgagagggaaaccatcagcaacatccgtatgtctttatccatcacagcaagtatggtggtcacagcactgacactgccgatcatcaactgggtggcagtaaagatcgacaatacccagctggcatggatcattgtaacagcagtattttcggtcatctctgtcctcattctgttaaatacattccgctgctgtaaggaaagggtaaaggtttctgaaaaatctgaggaaaaacttccgatattcacagcgctgaagctgatggcaaagaatcggtatttcctgatctccctgggtcttatgctgttctatacgatctatcagatcatccttgggatcgatctcacctattactgtcagtatgtgctgaatgatgtaaacctggtcatgccgttatccatggctgagaaagtaccgatgatctttgtcatccttcttctgccgaagctgataccgaagtacgggaaaagaaatatgatcgtagccggatgccttctcggcattgcaggccagattgttttcctgtttaatatcacaagcgtgccgctggcaatcttttcatccattatccgtggtatcggaatgtcaccgttctatggtgtgcagtattcgctgccgagcgatgcgatcgagtacggacagtggaagactggaaaacggattgagggacttatgttctcttccatgagtttcggacagaagtttggagcgggtatcaccaacgcagttttaggagcggcattatcctatgtgggatacaacggaatggcacagacagcggcagaacaggcaccggctgccattgcagtcattaaggtgacttatctttatgtaccgattgctgtatgggtcgtgatgatgctgatcgccctgtgctataagctggacaagacgtacaaggaaatgatagcggagctgaccgtgagggagctgtcagggaagctttaaaaataaagaaaggtaatgatagaaatgctggataaaaagaaagtaaaactgggaatcgcgccgatcggatggaccaatgacgatatgccggatctgggaaaagaaaatacttttgaacagtgtgtcagtgaaatggctttggcaggatttacggggtctgaggtcggagggaaatatccgaagaatgtcaccaaactgaaaaaagccctggacttaagaggaattgagatctgtaactgctggttttccagtttcctgatctccaaaccatatgaagaaacagaaaaagaatttatcgaacagaccgatttcctgaaagcaatgggagcaaaagtcatcggagtgtccgaacagagttacagcattcagggaaaggaccatccgatctttgaaggaaaatatgtaatgaacgatgaggagtggaagcttctcgtgcagggactgaacaaactaggtaaaattgcaaaagaaaagggaatgatcctgacctaccatcatcacatgggaactgtcgtacagacggaagaagagatcgaccggtttatggcagaagttgatccggagcttgtatacctgctgtttgacagcggacactgctcctttgcagggatggacccggtgaaagtgcttgagaagtatattgacagaaccagacatatccacctgaaggaccttcgttctgatgtggtggctcagtcaaaaaaagaaagctggagcttcttaaaaggagtcaggaaaggaaccttcactgttcccggagacggagacgtggatttcacaccaatctttgacatcatcgaaaagagcggatacgaaggatatgtcgtagtggaggcagagcaggaccctgccgttgccaatccgctggaatatgcagtgaaggcaagaaaatacattgctcaaaaaacaggtttataagttgtcggaaaggagagtagctgctctatgaaaatagcatttgacgtggatgtgctggcaaagcagatggatattaaccggatggtacatcaggtggcagactggggatacaaatacattgaacagtctccacatccgaggatcaatccgttttataaacatcctctgttttccaaagaatgtgaggcggaatacagaaaggcactccgggaaaccggagtggagatctcctcttttatcgtggtgtaccgctggtccgggccgaccgaagaacagaggaagatagcagtagccaactggaaacggatgatcgagatcgccgtggacatgggcgtgcccgtgatcaacaccgaactctccggtgatcccaatcagcaggagatctgcagcggcatgtggtttcggtctatcgaagaactgctcccgatcatcgaacgggaagggctccgagtagagatccagtctcatccgtatgatttctgtgagctgaataatgagacctgtgatctggtaaaatcctttcgatctccgaaccttggatatgtatattcttctccgcacggattcttctatgacgagggaaaaggtgacgtgagatcaatgttaaaatatgcgggagaagaactgacccatgtactgtttgcagatacgttcaatcagactctggactgccgctatatcgccaacccgccatggttaaacagccgtggaagggccgatgtgacgatccaccagcatttggctatgggcgagggagacgtggattttgaaggaatctttgagacattgagagagatggattttgccaataaacagctgaaagaaaatgcaccgaaagccggaggagacaatatcgcatgtgtatccatgttcgggtttccggaaaagatggagaaacaggcgccggaagcaagagaacgcattgagcgggagcttctctaaagaaagggtgataaattatgatctaccatacaacagtgaaagctgcaggaagtgatgtggcggcatttgctaaaaaaggatttttcataacattcggtgagccggctcttgtaagccttaaagacttttgttattttgtcgaagtgaatcctgtcatgggagaaataaagccgggcagcagactggtcattgacggaaacgagtataggattacagaagtcggcagcattgcggcagagaatcttgggaaactcgggcatttgacagtattctttcacgaagacagagaatgcctcccggggagcatctgtgtggaaaagagcaggatgccggaactgaaagcgggaagccggatttctattatagaataaaaagagaaaaagtgaagaattgaacagtatctttggtggcattcgttttcctatcgtcttatactaaatgagaaggagatataagagtcatgaagatgaaatgaaacggatgctggaaagtttaaaaagagactatggatataatgacacagacgcgggtttggtattaaaggatattttagttcatgcctggaacggtgaaatttaagacggaaatatagaaaaaactgctgtaccgatgatgaaaaatcaatggtacagcagttttttacataaaaagaatgcagtcggcgggacttgaacccgcacccagttagcccggactagatccttagtctagcgcgtatgccaattccgccacgactgcacaacacagttataatatcatggattttatggaaatgcaaataaaaatttgtatttttttctgaacatgaagccttttacatttcggagggtttcatttataataagagatgctttacaaatataatagaaaaggaatgaaaatagatgttaataggatcacatgtgggaatgaaaggaaaggagatgtttcttgggtcagtcaaagaagcattgtcttatggagccaatacatttatggtgtacacaggtgcgccgcagaacacaaggagaaaggatataagcgagcttaggattgaggaagcaaaagctctgatggaggagtcaggaattgaaacatttgtcgtccatgcaccgtatatcatcaatctcggaaatacggtgaagccggagacatttgaactggcggtggagtttttagcacttgaaatcgagcggaccagtgccatgggaagcagaaccctggtacttcatcccggagctcatgtgggcgccggagaggacgcaggaattgaacgtatcgttgaagggctgaatgaagttctcacaaaagatacaccggtttttgtggctctggagaccatggccggaaagggcagtgaagtcggaaggaattttgacgaactgaagcgtatctacgacggcgttaaatataatgataaattaagagtatgcttcgatacctgccacacaagcgacagcgggcttgatattgtcagtgattttgagggagtcatggattcctttgataaggccgtaggaaaagatcagattgcggtgtttcacattaatgacagtaaaaacccccggggtgcggcgaaagacaggcatgaaaacatcggctttggggagattggtttcaatgcactgaattacattgtgcaccatgaagatttcgcacaggtgccgaagattttggagactccgtatattaaagaggaagggaccaaaaattcttatcctccgtacaaatatgagatcgagatgctcaaaaatgggacatttgatccgagtctgaaagaaaagattttagagacaggaggtaaataggcaatgaaagttacatttattgaacacagcggtttttgtgtggaacttgaccggacggttttgctgtttgactactataaaggagcatttccggagatacctaaagacaaagagctttatgtgtttgcttcccacagccatccggaccatttttgtcgcaggatttttgatctggaagagaaatacccgaatgtaagatatattttatccgatgatatcccggcaaaagcttctcaaaatatcacaaagatcagagaacatgaagaccggatggtcggttccgttcggatcgagacgctgaagtccaatgacgaaggcgttgcattcctggttactgccgagggcaggacgatttatcatgcaggagatttaaactggtggtactggaacggggaaccggaggaggacaatgaatttatgatccggacctataaagaagaagtggcccgccttagaggaagagagatcgatctggcatttcttctccttgatcctagacaggaggataaatactgtaaagggatcaattatttcatgaaagagattcatccgaaagctgtgttcccgatgcacgcattcggagagtataagatctccaggcattatctgaactgtgatgacggacgggcttatcagggcatcgtcagagagatcacaaaggccggggaagagtttattctatgagagaaaagagcttaaggctggtagttgcgtttcccaatactaccaatgccatggcgatggagaagtactgcaggcagcggggtgtgggaggaaggctgatcgcggttcctccctctattacggcgggctgcggaatggcctggtgcgcagagccggaagaggaggctgcggtgaaagaagttcttaacgggcagtccattgagacggaaggaatttaccggattttgttgtaaggagagttctatgagtgaagagaatattgtgttttgcaaaagcggcggctgtacggcgaaactgggccccggggtgttagagcacgttttgagcaggctccccaagaaaaaggatgacaatctgctgattgggtttgaccatgtggatgatgcggcggtttacagactcagcgatgatctggccgtggtgcagacactggatttttttccgcctatggtggaggacccttatatattcggacagatcgccgctgccaatgcactgagtgatatttatgccatgggcggtacggtgaagactgccctgaatatcgtgtgttttccggaaaagatggatttaaacattttgggagaaatcctgctcggcgggaattccaaggtccaggaagcaggaggaacgctggcgggaggtcattctattgcggatgaggatgtaaagtacggcctgtcggtcatggggaccattcatcccggcagagtctatgcaaataacggagtcagggaaggggatatccttctgctgacaaaacctctgggggtcggcattgtgctggcggcgaaccagatgaaggcggcttctgctgcggcgtatgaacaggcggtgaattctatgacgacattgaataaatatgcggcagaaattctttcgggatatgaggtccatggctgtacagatgtaacgggcttcgggtttttaaaacatctggatgaaatgatcgaagaacagtatacggccgaaatcgactcttcccaaatcccatatattgaggatgcggcgcggtatgcagatgaattttatctgaccgcggcgggacagagaaacagaaattcggtcggaagtgatgtgtggttttcagatgttccgttctggatggaggaaatcctgtttgatcctcagacttcaggagggcttctggcaggcattcggccggaagatgcacagagcgcgctgggaaagttaaaaaaactcggcctgccgtgtgccgctgtgggcaggatcacaaaacggagagagaaaaagattcttgtttactaagggaaaggaagaaagatggaaaaaagaattgatgctgtcggaaaacagtgcccaatgccggtgatcctggcaaagaaggctttggaagaaacaccggaaggcggaacagtcacggtggtcgtagacaatgatattgcagtccagaacctgtcaaagctggcagtgcagaagcaatacggttttgtgtccagagagacaggcaaaaacacgtatgaagtaagaatgacagtgggaaccgcagacaaggaacaaactgcggaagaaaccgggaaaagaactgataatattcgggaaagaacaggggacacggttgtcgtactttcttcagataagatgggagagggagatgaggtccttgggaagatgctcatgaaagggtttgtctttgcgctgacccagctggaccaaaagccggacaggatgctcttgtttaataatggcgcgaagctttcctgcgaggggtctgatgcattaaaggatttaaaaactctggaggaaggcggaactgagattcttacctgcggaacctgtctgaaccactacggtctggaagaacagcttgccgtgggagaggtgacaaatatgtatatgattgcggagacaatgatgcaggcatcgcagatcattaagccttaaaggcagccgggaggtatttatgatttattttgacagtgcggccaccagctattaccgcccggaatccgtggcgcttgcggtggcggaggccgtccggcatatgggaaacagctccagagggcttcatggtgcgtctttggatgcttccagaactatatacgaagtgagggaaaagcttggaaatatgtttggatgcgggacttctcagatcgtatttacatccaatgtaacggagagtctgaacactgtcctctgcggactgctccggccaggagatcatgcggtgacaaccgtgctggaacacaacagcgtactgcggcctctgtaccgtctggaacagcagggagtggagttctccgctgcgggatgtgatgaactgggaaatgtgagtgcccaggatatagagtccttgtttcagaaaaacacaagagccgtagtctgcacccatgcgtcgaatctgaccggcaatctgacggacatccgcgagatcggaagactggctcatgagaggggaattctgatgatcgtggacggtgcacagaccgcaggtgtttttcctgttgatcttgtcaaagaccatgtggacgtcttttgttttacagggcataaaagtctgcttggaccccagggaaccggaggcatggcagtgcggcagggacttctcatagcccctttaaaaacagggggcagcgggatcaaaacctttgacagaggacagccggagcagatgccggagagattggaagccggtactttaaacggccatggtatcgccgggctgggagccggcatcgattatatcaggtcacagggcatggaaaagcttcggcagaaagaacagtgcctggccgatatgttttataaaggcgtccgtgagataccgggggttactctgtatggtgattttacaaaagaggagagggcgccgattgtgagcctgaatataaaagagatgcgttccggagaagtaagctgctggctgacagaggaatacgggatctgtacaagatccggaggacactgtgcgccgctgatgcatgaagcctttgggacaaaggagcagggaatggtccggttcagcttttccagctttaatacaagagaacagacagaaaaggcagtggaggcagtaagagagattgcagaaagttgaggaaaaggtatgctggcagtgatattggcgccgttttacctggcgctgaattattatctatataagcggagctttagctggcttaccgtatgtattcatattatccatccggacaagattcgtttttgttacagaatcctgtactggatcacgggtttttcccttttgatcgcatttgtgctgccccagtcgcggcttcagaggatttttaaaatcctgagtaattactggatcggaatttttttctgtgccctttttttggcagcggccggtgatctgatcggacttttcatcccgaagaaagaccagagtatattggcggcggcaggagtgatgattttagcagcggtcttggtttttacggtttacggcagtatccatgccagacatattgatactactgactatgtagtgacggtggacaaagcctgtgcaggcagaaaggagctcagagtcgccttagttgcagatctgcatctcggctataacagcggactttctcaggtgaaaaagattgtaaaacagattaatcaggggaagcctgatctggtctgtattgcgggagacatttttgacaatgaatacagggcggtaaaagatccggaaaagatagagaaggagcttgggaaaatacagagtacttacggtacatatgcgtgctggggaaatcacgatataggcgaaaaaatcctcggaggctttacgttcggcacaaaaaaagcatctgataatgacagacagatggaagaacttttatcccggtcggggatcagacttttggatgacaagacaatcctgattgacggggcgttttatctggcgggcaggaaagattcttcaaaagcacggaaaataggagaactgcgcaggggagcaaaagatttgctgaaagattgcgacctgacaaaaccggtcatcgtcatggatcatgagccgaaagagtttaaacagttgtcggaggctggcgccgatctggacctgtccggacatacccacgacggtcagatatttccgggaaataaaccttcgcggatggcgggtccccacacactgacaagacgttccagtgtccatgccgcattggccggactcgtagatggaagcttgacggcagatcttccgagagaagactcaatgtgtttacagaataacttgtgggaagttccgccgttggtgtaaatgctgcggatgggggcaagggaaagcagattggtcagatcgtttggggtcacgttacggattgagctgtcgctggaaccccggatgtcgcaggatgcgattacatcccagaccgctatgtgattggacaggagaaagagggttttctcctctacggtggcgggaacaggctgggagagcgaagcggcaagcactttccagaagcggttctgagggtgatggtagaaaaactgcccttctctggattttacagaggggaagcttcctaagatcaggattctggatttgtcgttaaaaactggctttatttcatgtatcatgtgttccatcggggagtttcctttctgattttctttatttctaatggtaatggatttttttcacggattcaaggtaagattttcttgccttgcaaaacaaggtatgttaatatcttaacgtatgtatagatactatatacactctggagagtctcaaagaaagagcgccgaaggtgtacggcagcgcaagctgtttatctctcaggcaaaaggacagagcagacataatcgtgcggcacgttttcggtgtactgtatatttgcttactctttcttagtcaaactttgggtttggctttttttattccataagaaagttctacgaccttccctgtgaaataaaaacgctccgcgggttgtacacagatgcgtaagaaaattatttggctacgtcaaatcgcatctggcacgcaaagtgggcaagcccctcaaagattgaggtgctggggagttaaagtgggtttgcccactaagttcttccataaagagttctccatgaatttttaatgaaaagaatacaggaaacgaaagaggagaaggaaacatgctgacacaattgaacaattttattatctggcttgacgatgtagtttgggggataccgctgatcgtcctcattttatctgtgggtatttatctcaccatgcgtctgaggcttttacagatcaggcatctccccagagcattaaaatatatggtgaaaaatgaggagggaggctccggggaagtcaccagttttggtgctctctgtacggccctttctgcaacgatcggtaccggaaatatcgttggagtagcgacggcgctttgtgccgggggaccgggagctttgttctggatgatcctggcggcatttttcggcatggccacgaaatatgcggaaggccttttggcgatcaaataccggaccatcgatgagaagggccacgtgctcggcgggccgttctattacatagaaaatggtatggggcgcaaatggaggccgctggccaagatttttgcttttttcggagcgggcgtcggcctgttcggaatcggaacattcacacaggtgaacggtatttcaggagcagtcaaaaatttctttgatccaaacaatgcccatgtgatctccctgttcggaaaagactattcctatatggtgcttgttgccagcgtgatcattacgctctgtgttgcggcagtagttctcggagggatcaaaaggatcgcggctgtttcccaggtagtcgtgccgtttatggcggtggcttacgttcttgctgcgctgagtatcatcatttttaatatacaggaagtacctgcggcgatcgcacttgtggtaaaaagtgcattcggagtcaaggcaatggcaggcggagctctcggaacgatgctggctgccatgcagtccgggattgcaagaggtattttttccaatgaggcgggccttggcagcgcgccgatcgcggcagctgcagcccagacaaaagagccggtgcgccagggacttgtgtccatgacaggaacatttatcgacacaattgtgatctgtacgatgaccgggctcagcattgtcatctccggtacatggaatgtagggcttgagggagtggaagttaccacaaaagcgttccagatggaaatgccgtttccaccggtcgtgccatccttcatcttgatgctctgccttgtgtttttcgcatttaccacaattctcgggtggaattattacggggaacggtgtctggaatacctcacaaacggcagaatgaagatcgttatgggataccggtatctatatattctggctgtgtttatcggaccatttatgacggtggaagcagtatggaagatcgcagatatctttaacgcgctgatggcacttccaaacttgatcgctttggcggcattaagtccggtcgttatcgcagagacaaaagcctattttaacaaaataaaatcgaataaagaataaagaactgtaaaaagatatcttcgtataattaatgaagatatctttttgtcgatggacgaattctgcatacgcaaatcaagtaaacaatgcggaagccagactctgcgggcgcaaaaagaaagttaaaggagcactggaatagcggtcaattataatattaaaaactggccctgtcaaaaaaataaaaactggatatttatatagtaccagcaaactgtataatgaattactatatcaggctgatataataacatatttaaatagtttgcatttggaggatttcagaaatgaataatgagcgttaccagttaaataaacagttggcacagatgttaaaaggaggagtcattatggacgtgacgactcccgagcaggcaaaaacagcagaggaggccggggcctgtgcggtcatggcactggaaaggattccggcagacatccgtgcagccggaggcgtgtccagaatgagcgatccgaaaatgatcagagggattcaggaagcggtatccatccccgtgatggcaaaagttagaatcgggcattttgcggaggcacagatactggaggcgattgagatcgactatattgatgagagcgaggtgctttcgccggccgacgatgtatatcacattgataagacgaagtttcatgtgccgttcgtctgcggggcaaaagatcttggcgaagcgctccggcggattaatgaaggtgcatctatgatacggaccaaaggagagccgggaaccggagatgttgtccaggctgtgcgtcatatgcggaaaatgaaccgggacatcagaaggattgcctctatgtcggaagacgaattattcgacgaggcaaaaaaacttggagtaccttacgaattggtgctgaaagtgcacgaagacggcaggcttcccgtagtcaattttgcggcgggcggggtggcgactccggcggatgcggctctgatgatgcagcttggggcggaaggagttttcgttggctccggtatttttaaatcgggtgatcccagaaagcgtgcacagtctattgtaaaggccgttacgaatttccgtgacccgaagatacttgctgaattatccacagatctgggagaagccatggtgggcatcaatgaagatgagattcagcttttgatggcagaaagaggccggtaatgaggatcggagtactggctttacagggagcatttacggaacaccgcaggaagctggacggactgggtgtacggagttttgaaatacggaggaagaaagacttagaaaaccagatggacggaatcatccttccgggaggagagagcacggtcatgggaaagcttctgcgggatcttgagatggccgatcagattagaaatatgatcataaacgggcttccggcttttggaacctgcgccgggctgattttgatggctcaaaggataaaaggggagagcgcttatcttgcgacgatggatatcacagccaggagaaatgcctatggacgccagctcggaagtttccgaacagaagaacagtttggggaagaaggaaaaattcccgtgacgtttatccgcgcaccctatattgaagagacgggaaatggagttaaggttttggccttatcgggaggaaagatcacagctgccagacaggataatcagctggtcacggcttttcatcccgaactggatgaagacaataccgtccaccggtatttccttggtatgataaaagaggcttaacggtcgacaagcaggctctgctgcattataataagcttcaaagtccttcaaagagagaaagaatgggaagatgaagcgggcttgcccgcttagtccatcagaaaagaggagaaagaatgaaaacattaatactggcatccgcatctccgaggcgcagggagatactgaagcaggcaggactcgattttgaggtgatcccgagcacaaaagaggaagtgatcacaaagcaggaaccgaaagatgcggtgatggagctggctcttcaaaaagcggaagatatagctggccgtgttgacggagactgtatggttgtaggcgctgataccgtagttgccatggagggcagtatactcggaaaacctgagaataaggatgatgctgcccggatgctccgcatgctcagcggaagcagacatcaggtgtatacaggtgttgcgtgtatctgcgggggaaagaaacatgttttttacgaagagacatccgtcttcttttatcctgtttcagaagatgagatcagatgctatattgagacgggagaaccgatggataaagccggagcttacggaattcagggcagggcggcgcgtttcattcgcagaatcgaaggagactactacaatgtagtaggatttcctgtcgccagctttcttcaggtattaaaaaaatgggatgagcgaagcagcagccggacgtaaagtctggctgttgttttttttgatgtttacggtaataagatgtacactccgaaagctgcaaaaaacggaagccagatcagctgttttcattttccaacaaatttaacaagattcttgtgtttgtagtgacagcccaatatctcaagattgatatgaagatcatccgggatatccatctggaccgcaacaaatgatgaacagaagaagagatggcttttggatctgcagagttaagaagtatatgaattgaatagtaaaaaaccttcggctgcggcagagaaaaagccgtttccgaaggtttttatattgtttatatggaatgggccaaagcttggcagaggaacaggaatgttttattcttcttcatcatcctcgtcgtctaaaatagcatcaaaagcagcagaaaccatctcatattcctcgtcatcctcaatattgtccagctgaacctcatcatccggcaattctttatagcggtaaagaagcagttcactttcttcctcatcgttctcaaggtcttttacgggaaccagggcgatataatcctgttcttcgatgccgaagatacagatcacggcgcagtcgagctggacaccatcctccatttccagatggatgattggattttcttcttcaaatacgtcagcttctacgttgatatcttcactcataagactacctcttttcttagaatccggctttgtgagcacagaaattctactaattttatttgcatttttgggctgttcttaatatactaaataataaaggaaaaagcaaggggacaaagagattgttacaggtttgacaagtgttttcctgtgtgatacgataccatcgaatattggcagcggaggctattattatggaagaatacagatatttattggatatagcggtgatactggttttgacaaagtctttcagcctgttctcgagaaaagtaaacatgcctcctgtagtcggagcgttgattgcgggtattatactgggaccggtgatgctgaacgtgatcaaaccgtctgatactatcctgagtctggcagagatcggtgttattgtcctgatgtttcaggcagggctggagaccgacatcagggaactgaaacggagcggaaaagcagccatggtgatcgcgctgtgcggagttgtcgtgcccctggcggtcggagcggtcatctcttttatgtttgaaaagaatttaatggaaaatatttttgtgggggttattctgactgccacgtctgttagtataacggtagaaactcttcaggatatgggaaagcttaagggccgtgtcggaacggcaatactcggtgcggccatcattgacgatatcctgggtattatactgctttctgtgatgacaagcatcggcagggccggaacggttgaggtcacaggagttcttatgataatcggcaagatggctctgttttttgtgctctcaggtgccggcggaattgttgtgtacaagtttttccgcaggatgtccacgatgaaagtaaacaacgaacaggtccacagaaggcgggttccggtgcttgcactggcattctgcctgtttctggcatttttggccgaattatttggaattgcagacatcaccggggcatatctggcggggatcatcctgtgcagaataccggagacttactatattcaccggaaggtggagtgtatctcatacatgctgatcaccccgatcttctttgccagcatcggcctcaaagtcgaagtggcgggaatgactcagacgatgatcatcttcactgtacttatcagtattgccgctgtcctgacgaagatcatcggctgcggcatcggggccaaggtctgcaggtattcctataaggagtccctaaagatcggagccggcatggtttgcaggggagaggtagcactgatcgttgcacaaaaaggaatccatgtcgggctgctcagggaagagatgtttgcacctatggtcattatggtgttggtgacaacccttttggcgccgattcttctcaagctgtttttttcagagtggttcagcggattgacgtacaggacaggaaagagataacaggatgattgagacagtagtatcagtaaagctcccggtgcgggagacattaaggattaagaagaattccctgcatccggacgtgatgacgggaagagaaaagagaatatgcctcgtttcaggtttatatggagatgagcttggagggcagtatatatgcggagaaatcataaagaggatcaaagaggactatgattccctgtcaggaatcgtggacgtatatccgtcggtcaaccctttggggctggatgccaggagccggagcatcccagttacacaggaggattacagcgcggtttttccgggagacttaaaaggggaactcggggaatatacagcggccaagctgctggaggatatggagagtgcagactgtgtaatcgacattcattccagcaatattttccttcaggagatcccccaggtgagattaaacagcgatgcggacgagcgcctgctccgcctcgcaggatatatgaatactgatctgatttggatacatccgtctacgacagtgaatgagggaagcctttcctatgccctgaatgaacggggagtgccttgtatggtcacagaatcaggggctgcattcaggattaaatatgacttctgcagacagatcatagagggagtgtttgccatcatgaaggaactgggcatctggaagggaacgtgtgcagaaccgaaaagggccccggtcgtccatgatgacgggattcattatctgaactgcgagacgaacggtctgtttgtcactcacaagaaggtgaaagattatgtgaaaaagggtgagatcatcggcagcatcaccagtcccatcctgggagcggtggaggaagaaatcattgcgccggtggacggtatcttaatgactgtcagagaacacccgggcgtgacggaggggtctctgatcgccagagtcgtgggaggtgccctggtatgatcaaagagacattgtatacgacagattcttacctcagggaagaatttaaaataaaaggatttcggttcggcagtacaggcgaagactcagaaccgtctgcctgcattgtcggctccatgagaggcaatgaatttcagcagctttttatctgctctctgctggtaaaaagactgaaggagctggaagcatccggctcgattgtgggaaatcatgagatcctggtcatcccttcaatgaataattcatcaatgaatgtagggatgcggtattgggtatcggacaacagtgacatcaaccgggagtttccggggaatccgcagggagagccaaccagccgtctggcggccaatatatttgagaaagtaaagggctaccgctatggaatccagtttccttcattttaccggaagggagattttataccccatgtgcggatgcagactacgggaaaggaaagtgcaagtctggcaaatttattcggactgccttatgtgatcacaagcaagccgagaagctttgatgtgaagacgttaaattataactggcagatcaacgggacagatgcattttcagtctattccggtgatacgggacatatcaatgagttttcggcgaaacaggctgtatctgctgttttgcggtttttaaccagaatgggaattttaaaatataattgccataacggctatattgcaagtattatagaagaagaggacatggcggaagttaagacggaggcaccgggatttttccggcgtcttgtcaatgtcggagaggaagtgcaccggggacagctcttaggagagatcctggacccttacgagggagatattatttctgcggtgcattccaccgtggatggaatcgttttttacgcgaagaaagatccaatgatcttggagaatgcttctgcgtttcaaatcataaagaagctgcacgaatagaggaggaccatatgggacaagtaaagagagtttatgtggaaaagaaacagggctatgccatcaaagcaaaggaactgctggaggaagtgaggcagtacttgggattggatgtggaaaatatccgcgtactgatccgctatgatgtggaaaatgtttctgaggaaagctatcaaaaggcgctgggcaccgtgttcagtgagcctcctgtggatgaagtttatgaggaagcgttccctgcggaagaaggggaaacggctttcagcgtggaattcctcccggggcagtttgaccagagggcagactctgcccagcagtgtctgaagctgttaaatgaaagtgaagaaccggtcatccggagcgccactacatatgtagtaaagggagcattatctgaggatgagatggggcagatcaaagattactgcatcaatccggtggattccagagagtcctctgaagaaaaaccggatactcttgtgatggagtttgaagagccggaagatgtaaagattgtggaaggattcagggatatggacgaacagccgtttaaggaactttatgattccctgaacctggctatgacctttaaggatttcctgcacatccagaagcattttaaagaagaggaacagagagacccgtccatgaccgagatccgtgttctggacacatattggtctgatcactgccgtcacacgaccttttcaacggaacttaaaaatattaagttccaggaaggcttttaccgtgctcctttggaggcgacctatgagcagtatatgctggatcacaagagcattttccagggaaggaaagacaaatttgtctgcctgatggaccttgcgctgatggctatgcgccggctcaaacgggaaggtgccttaaatgacatggaagagagtgaagagatcaacgcgtgcagtatcgtagtgcctgtctccatagacggaaaagaggaggagtggctcgtaagctttaagaatgagacgcataaccatcctactgagatcgagccgttcggtggtgcggctacctgcctcggcggagcgatcagagatccgctttccgggcgttcttatgtgtatcaggctatgcgtgtgaccggagccggcgatcctactgtaccattaaaagatactttaaaaggaaagcttccgcagaggaagatcgtgaccggagctgctcatggatatagttcttacggcaaccagatcggattggccactggatttgtagatgagatctatcatccggattatgtggcaaaacgtatggagatcggggctgtcatgggtgctgcgccgagaaagaacgtcgtaagggaaagctcagatcccggagatatcatcgttctgctcggcggaagaaccggacgtgacggctgcggaggagctaccggatcttctaaggtccacacagaagagtccatcgagacatgcggcgcggaagtacagaaaggtaatcctccgacagagagaaagatccagagactgtttagaaggaaagaagtcagcaggctgatcaaaaagtgcaatgatttcggtgcaggcggtgtttctgtggcgatcggagaactcgcagacggacttacgatcgatcttgacaaggtgccgaaaaagtatgcgggacttgatggaacagagcttgccatctctgaatcccaggaacgtatggcggttgtcctggacccaaaagatgtggatcagttcttagccttttccgaggaagaaaacctggaagcagtggcggttgccgttgtaaccgaggagccaagattagttctctcctggagaggaaaagagatcgtaaatctgtcccgtgcatttttggacacgaacggagcccatcaggaaaatgatgtatatgtagagattccacaccgcgtcagcagcttctttgataaggagattccaaagagttttacggaagcatgtattaatacactgaaagatctgaatgtatgctccaagaaaggacttgtggagatgtttgacagcaccattggtgcaggcagcgtcactctgccttacggcggaaaatatcagatgacaccggtccagacgatggtagccaagcttccggtgcttcacggaaagacagataccgtgaccatgatgagttatggatttgacccatacttgtccaaatggagtccattccacggagcagtttatgcgatcactcattccatcgcaaaaatcgtggcagctggcggtgactacaagaagatccgtctgaccttccaggagtacttcaaacgccttggagaagatccggagcgctggggacagccattcgcggcactgctcggtgcataccacgcacagatcggatttggacttgcatctatcggaggaaaggacagtatgtccggaaccttcaacgacattgatgtgcctccgacgctcgtatcctttgctgtagatgtggcagacggaaaacacgtgatcactccggaactgaaacgcgcaggcaaccgcctcgtgcggatctgtattccgagggatgtctataaccttccggtttacagtgaggcgaaaaaagtttacaaacgtatccacaggctcatagaagaaggtgcgatcaaatcctgctatgccatcggattcggaggaaccattgaagcggttgccaagatggccttcggaaatggccttggagttatttttgaccaggaagttgaaatcaaagatcttgttgagaaccattacggatctttcgtggtggaaatggatacgagggatatcagaaaacttgcgatcccaagccttctcctcggtgagatcaccacaacaccggaacttgtattaggaaatgaagtggttccgctgaaagaggccgcagatgcgtggaccaagcctttggaagaagtcttcccgacccgctctgaaggaagccaggatgtagtagagacaagaaactacaccaaaggcaaggcgcattttgccaagaataaaatagcgaaaccaaaagtatttattccggtattcccgggtacaaactgcgaatatgattctgcaagggcgtttgaagacgcaggggcagaggtcattactaaggtatttaagaacctggacgcacagggaatccgtgactctgtagatgagtttgaaaaagcaatcaaagagtcacagatgatcatgttcccgggaggcttcagtgcaggtgatgagccggaaggttctgccaaattctttgcaacagccttccgaaatgaaaagctcaaagagtctgtcatggacctgctgaacaatcgggatggtctcgtgctgggaatctgtaacgggttccaggcactgatcaaacttggactggtaccggaaggaaagattgtggagcagacagagcagtctccgacgctgacgatgaaccggattggacgtcatatttcaaaagtagcctataccaaagtgacttcaaacctgtcaccatggttccatgaagtcaatgcgggagacattttcagtatccctgtttcacacggagaaggacgttttgtggcaaatgacgatgtgatcaaaaagctgtttgaaaacggccaggtggcaacccagtatgtggacttgaatggagatcctactatgaatgaggactttaacccgaatggttcctattatgccatcgagggtatcacaagcccggacggaagggttttgggaaagatgggccattcagaacgtatgggacgttttgtttccaataacattgccggaaacaaaaaccagaagattttcctttcaggagtgaactattttaaataatcagatcccggtatcataataagaaccccgcagtgtactctgcggggttcttatatttaatgaaaagagaggattaaaaatatatatgaaaaacgattgcctcagggacatgctgtgtttcatgtcttatgaggtatgtttttagtatagcaggattaccgtaggaaacaatggatagaaaataaacaattctaaatgaaatataaacaaatcttatacccagagggcaccccgtattctatacccttcgggtgtagaattcttgtgtttctggagaaaaagaaaaggttcatgtgaatgagctgataatattttggttaaaattcggaataaatattgaaaatattatctaaatatactaatatataatcattatgtaaccaacgactttctcatgaaaggagtcttctttatgtcagatgcaaaaggaaaactgtttgaaactaatgaaaaattcccacagaccgaatattggaacgattcttgtgcggtaaaagaactggagtatgccatcgaccgtggagcaaccggggctaccaccaatcctgtgatcgtaggaaatgtattaaatcaggagatggatctctgggaagatactcttgtaaagtggatcgatgaaatgccggacgcaacagaggaggaggttgcatggcgcctgatcgaacagatggcagtgcgcggagcaaaacttcttaatccggtctatgaaaagacaaatcataaaaaagggaaaatctccatccagaccaatgcaaaattatacagaaacgcagacgcaatggcagaacaggcaatcggattcggggacctggcaccgaatatcatggttaaaatgccgacttccgcagcgggaatcaaggcatttgaggaagctaccttcgccggtatcagtatcaacgccactgtatccttcactgtggcacaggccgtagcagtggcagaggcagtagagcgcggattaaaacggagagaagaagcgggactttctaacgagaatataacaccggtgtgcaccatcatggtgggacgcacggatgactgggtaaaagaagcagtgaaacgggacaatctgtgtctggatccatgcgcattagagtatgcgggagttgcagcattcaagaatgcatataagatctatcaggaacgcggatataagacaagacttctggctgccgcgtacaggaattatttccactggtcagagtttatcggcggagacgtggtgctcaccatcacacagccttggcaggagaagatcaacggaagcgacgtggaagtaaaagagcgtatgagccgcccggttcccgaaaaatatctaaatgaactgaagaagatccctgattttatcatggcatatgaagaagacggcctgaaaccagaagaatttgtacattacggagcctttgtaaagaccatcagccagttcctgggaggatacgaaagccttctcggggtgatcagaaaactgatggtgggagaccctattagaaagtaaaataaatagacggcaaaacagcaggtatcctatggatcatacctgctgttttactctttcattggttcattggttgtttcatcgttctgcacgtgtacctcacattcttttcttcggtgggatatagtaatgaccgccgttcattgcggtgatcccggcgctgatgatgtcacagttatcaattaaatattttttcactttctccttcaaggacagttttgctgtattggctggagaagagtttgctgcattcatctgtactgcttttgtatttgtcatatcggttcctcctttcttaaatgatgtttttcttttacggttcctatgatatcattgtatacaaggattgattagatgattttttgaccagtttttagggcaatattgacaaggaggctgggtgataggaaaggaaagcgctgacatatgtatgaaacactctacagacttgaaaagacaggtatagatatcaaatattggactaacaagggacagtatacccctccccattggcatacggccatcgagctgatctatgtgctgaacggcacgggatccgtgatctttgacgggaaagagcatctcacaaaagcgggggatcttctggtcgttgactccaataaaatccatgagatgaagtgtgcggaagtctccatgatgatcataatccagttttccaggaaaagaatgaagaactacgtcaaggacattgacagcttccgcctgtcctgcagccgggagagcgcggagcatggaaaagaaaaggaataccagtcggtctgcggacttttgcgtaagcttccccttttgtatgtgaggcagcccgtgggatatgagctaaaaagccaggcagtcgctatggagatcctgtatgagctgctgaatcattttggggaagaggataccgggaggaccgcagagaaggaaggagctttaaaacgtctgggtgagatcacggattatattgaagagcattacagagatccgatcccgctggaggagatcgcttcccatttttacctaaaccgtgagtatttcagccgcttttttaaaaggaatatgggagtgtctttctcaagatatgtcaaccaggtccgtctgctgcacatatactatgatatctgcaacacggaggaggggatcatggatctgattgagaagcatggatttaaaaattataaactgttcattaaaatgttccgggaaatctatgggagcacaccgagggaagtccgcagtgagagaaaaggacagacataaaacaaaagcaagcttgcttttgtttcttttatagaaaacgtttttcccatcggttatctgtatacaaagtcgggaatttggaaaagagatagacttttggtaataaattgagtataattagaatatatatttataatatagttgaatattgttagggaactgttgcaaattatgaatatattatgataattttctgaaaccgagattggaaaggagaaactatggaaaaaacattgatcaccatcagccgccagtacggaagtgatggaacaaaggttgcacaggttttggcggacaagctggatgtctggtactataacagagatatcctgtatatggctgctgagaagatcggcgtggatgatctggatgagaaatcgctggaagagctgaattacagaaaaagctcccgatatgtggagggactgagtgtcatgatgggaacaccgggacacattccggtctacaatcagatgtttaaggaacagtccaagatcatccgcaagcttgccggatacggctctggagtctttcttggaagatgtgcagattacgtgctgaaagatatggataatgtttatacaatatatctctatgcagatgatgaattccgtataagtcatctgtctgaggcggaaggccgcgagattacaaaatctgaattgaagaaggaagataagacaagagaatcttactataactactacactggacagaaatggggcgacgtacagaattatgatctggctgtcaatatgacgaaaatcagccctgaaaactgtgcagagttaattcttgagtacattgaaaagagaagaaaataagaataataaaaaggcatcctcagagtttgtatttaactttgaggatgtctttttagaaataatgggagataccgcaaactatatttgctatcagtcatttattttccttcttagcccttcaaaaacttcttcatgtgaataacgcctactgttattttgggcggcagcatcagccttataaagagcagtctctaaaccgtctgttagattggaatatgcctccagactaagaactaccatagaaccgtaaccattttttgtaagatacacaggctcccctttgttgaccaatttttctatatcgggaaacttatttcttaagtcagaaacaggtttgatctgtatcaaatcatcactccttatcaataatttatcgtaatattatcattgtttttattataagctatcgactcatagattacaagtattatagacaatatttaatcattatggtagattaaaaggagaatacaaaaaattatttagaaaaaggaacattggacaggagatatcgcaaatgttggataaaaaaagagacaaaaagcaggaacggattgaaaattttgaaagtcagagagaaaaaatgaaaaaggcagggtacaaggaatcctccgggatcatttctgtgctgagggccaatgttttggcgtttgctactgccggaccaatctgtattgcagcttatatactatatttcattcgctggggagaaagtgggtggaccatgaatggaagaaatctgatcttcttttttgcactattttttgcagccatatttgtccatgaactgtgttatccccaattagtaggaacaatacagctctctggcgggcggcggcacgtcaagaaatatattatggagtttttaaagaatcccccggagcgggggagcggtcagtctgtgacctgctccacttccggtatgggtttgagattaaaatgaatttcgatagaaatgtgtcttgttttgtcgctgtctatggtttcatggacaacgatttctttcatcaggcggttcaggatggaagcgtccagcacggtgatgtcccggtattcctgtatggattccacccactgccttgcgtccacggcaagccggatttcatcggcaaggcgtttccggccttcctcaaccttggcttttaattccgcctgttccttctgtgtcttttccagcaggagattgaagttttcttctgtgattcgtccggctaccatatcctcatagagccgcaataccatcttttccagcacttcaatccgttcttcgtctttggcaagggtgcgctccatcgcttcccgctggcctttctgttcggcttcgcaggtgtttgtcagccggttagctaccgcttcactgtctgtcagggcagcggcggcgcactcccggattttgttcagcacaagggaatagagcgtgtcaaactcaacccgatgctgtgtgcagtgctgcttcccataggcattgtaggttttacaggagaaaatccgcttcgggaacttctcatgcgtggtgcggatggtgagagcctttccgcactccccgcattttatcagccctgcaaagaggttgatttccccggatttgcccggtcgctggcgggatttcagtttttcctgcacaatcgcaaagtcctttttgtccaccagcggctcatgcgtcccctccaccacaatccagtcctccggcttcttatcccggatagtgccgattttaaagcggtactcggtcttttgggaagcgattgcgccggtgtagacggggttcatcaggatttccttaatcacggagaagtcccagacgtaccgcccgttttccgggtctttcttttcccatttggtgcggatgttccggtgtccccgcttccggttccaccatgtcgggcaggggtgcttttcttcctccagcctgcgccggatgtagttggggccgtggccgtccagcgcatacccgaaaatcagccggacaaccggggcggtttccccgtcaatgagaaggtggttcttgtcctccgggtctttcttgtagccaaacggggcgatacagccggtgaactggcctttctgcgccttcagcacataggaagaatggactttcttggaaatatccttgctgtacatttcattcaggatatttttaaagggcgcaatgtcgttgttgtcccgcatggtgtcgataccgtcattcatggcgatgtagcgcacaccgttccttgggaagaagtcctcaataagctgcccggtctgcaagtagttccgtcctaacctcgataaatcctttgtaatcacaaggtttacctgtttccgctcgatggctttcaacatccgtttcaggtcggggcgttccatgttcaaaccggtgaagccgtcgtcctgatagactgccgtaacctcccatccctgcttctggcagaacttttccagcatatcccgctggttctcgatactggcactcgtcccgtcaaggtcgtcgtccttggacagcctgcaatagatagctgcccggaaactcccggcaagaagtgtgtccattcctgtatatccaaaagtgttcatcataaccgtttacccgcacaatccagacggaacacggtcacttggaacctcacctttattatatcctatttcttgtgatttagcaagataatctttatctgtttttctgctgtgtttctgtgcgatgaggcttacgaaaacgtccgtagcgtccagctcgccgtcaaatactgtggtgacatgaatctctgttttatttttcgccataggcagttgtcctccatagatgaaaacagccagacagggaaggtcggcaacgaagtccggcaacgggcttcaaaaaaccttggaacgaatccttgtctggcggttgggttattttatactttttcttttatttttctgttgctttggttgttaaaggggagaaaagccgacagttacgggattttccccggcaaccggcccggcaacgggatagcaacgaagtgtgcaacgggctgtcatttaccggattttttcaaaatggaagttccatctgttccggcaccggcgtaaatccctccggggtttttcccgccccgttgccggtgtccgttgtcggctgctcccgttcccatcctttctgtctgccatatccggcaaacatccgggggttggagaaatacttccagccagtaacgcactggttcattatctcgttgatttcccgtatctcccattgtttcggctcgtcaaaggcgtggttcagggcttctttgtatagctgtttggagcagacggtatcgccggggtagctgtcaaggaaagcctgaatcatcccggccttggtgtcctccggcataaagtcccgctggcgttcctttagatagcgcaccatttccgggctgaatgtcagcttccatctgccgcttttgtaaatctccatcgcttccgcccacacttggtttaaataggctctggaagcggcttcgtcctctaagatatggatttgcgcctgttccgggcatacctgtatgggaataaagcggcggttgccggagcggtcaaggggcaggaagtcaagggcattggacgtaccgccaaacacgcactgccttgggcggtctgccgggtgggtttcgtagggtatcttgtagacttccttctggcggctcaaaaatgacttgatttcctctatgctcttggcgtttgcggtggcaatcatctccgacatctcgattatccagtggccttgcagcttgcggtatacgttgtcatcgtccagctttcgtaaatcatcggaaaaccactcgtctttgaccgccagcaggcggaagaaggtggacttcccggctccctgaccgcctaccagacagagcatgatttcaaatttacagccgggggcaaatgcccggtggatggctcccaacaggaacaggcgcagggattggtaagtgtaatcgtcctcaccggctcccagaaagtgccgcaggcaggagcgtatccgttcggttccgtcccatgtcaggctgtttaaatactcccggacagggtggtagctgttctcgttggcggcaaggtcggcagcgtcctgtatcttcttttcactggtcagaccgtaagtttcttccagatacagccggatatatttcatgtccgtgtcggtcatggggctgtttggggttctttggtagccgatgggctttaaaatatcggtgcggtcggtcagcaggttataggcaaccgccccggaaaggagcgggtcgcactgaaacacggtcaggcagttgcggatactgtttcggaagccgcctttttcggtggtttccagcaaggctttgacgtcctcaacgctccggggcggctcggtgttttctgccatgttctttacttcctgccgtatctggggcggtaagttctgccattcgtctttcaaggttcctcacttcctttccgtgtcctgtgataagggctgcccgctctggaagttcccccgataaaagtacgtccatcagatattccagacggctcatgttttgcagggcttctataaaccggggattccatgcttcatctggctgtttaggggcgtattcttccttccagcggcgcaggagatggtaatagtcggacagtacccggaagcagtgccgctccatgcgcttaaatttctgttcctccgtttccctacgcaggcgtggtcggatgggctgcttccttgcgttcctgccatcctcataggggatggagaagtcctgtgccagcatgagggcggcttctttgctgccgattccataaagacgggaaacaaagtcaatcacgtccccggtggctccgcagccgaaacagtaaaagcggcggtcaaccttcatgcttgggttcttatcgttgtggaacgggcagacgcacatcccgttccggtttacatggattccataatgctccgcagcctgccttgtggtgacggactgcttcacggcttcaaatacgttcaataggcgtttcctcctgataatcccaacgtgagcggcacaatgtcgttcacattgtctgtaaatccatcttgttcaaaatgaaaaagcacctgccagcgatttccaatcacaaaacaagtgcctgtttaaagttccatattctgttgtttctgtgtccggggcggctggcgtttctctgcctgctcctgccggatgcgttcctgccgccctttcaggttcccctgtacggacggtttctttcccggctcggcggtctggcggtactgttcagagggcagcacttggttgagccagcggcgcacatcccgcagcacttttacatctgcctgaaccgcttccagttcctccccctgttccggcagggcggcagcaagctgttcccgttccgcttccaaatctttgcgggagtaggaatggcctttcaggctggctttcaaataccggatggcggcattgtaagcgtccagttcctcccggtggctctccgcaaactgctcttttttcttcttccagccgatggcggcgtactccttatggactggcttgttggcttcgtatttatcaatgtaggacagcatggtgtcgatggctttgatacgcttctcgctttttttcatgccctccatgacagaaacggcggtctggctgatttcgtccagccgggtgtcaaggctttccacggtggagattcctttttcccgcagaaaatccattgccgcctgtaccttgttgaagtcggcaactgtgcctttgagcttccctctggaagtccagtcggcacgctgtccgctccgcagttctaaatactgtgagagcagctccggtatggtcggttccttcgtctgctccaatgcttccatcagagcggcttttttctcttttaaatcggcaatccagccttttaagtggcgcaccatctggcggatggactgcatgagggagttggcggctttgatgtcccggttcaggttgccaacgttggtctggattcctttcttctccatctggcaggcggctgcccccatgtggacggtggggattttatcaatcccttgtcgggcataggagcgcaggtcaagccgttccgggcggtgattggcttctaagtaacggttagccgtgtccgcccatccctgccgccagatttcggcgtacttccggtcgttccagtctacggtgttctccttgtggcttttccatctgccggacgggagccggattctttcgccgttcccgtcaaggtcatataccttgcggcatttggggagccattttcctttttcgtccatcgcccgcatggtgagcaggatatgggcgtgggggttgccgtcccctttgtcatggatggcaaaatcggctatcatgcctttggaaacaaaaaactcccggcagtagtcacggataaggtcggcgtgctgttccggcgggagttcccttgggatggcaagcacgaacctccgggcaagctgggagttccattgtttttcctgcgcttcggcagagttccataaagtattgcggtctgcatactccggcggcacatggggcgggagcatgatttctttgtgggtgacttcgttcttgtagggatagtgtttctgctcttggtcgtattcagagaacagcttttcgccgctctggtaggcggcggcagaaacggcggattcattgttgctccgcttaatgatggtgattttacagtgcgggcatggcaagtgtgcgtcctcctttctcccggattccgggcaaaaaaagagcaggataacctgtttagatttcctgctctttgccgccattgatggatggttgatatttagttgtccttttctttattcgttcccataaaaggcttcaatcgcctgtgcgaaaaaatccgaagccccatctccgtacttttcatccgtcatcgacttgattttttcattgcggtaatactgcgcctgcgccagcatgaatcctttttcctcttttacctgtgagagttgtttcataacaaagccgtattccccgactatctcttttacttcaaaagaatccacggcacaatcccgtttagcgattagtttttgcagaattgcttcaatccgtttgttatagctttctgcaacttctttactgatggggttctgggcgacagataaaaatttgtctttcccgccataccattcaactacctttgcatatcttttctgcattttttcagaagatacggcttccatgtaatgctttttccattgttcaatgctcccaaattcttttattgcgatgtttctcatgttttctggcatatgctccatcatagtctggaacatttcctcaatctctgttttactgaaaactgcaaaatccattttgttttctcctttcaggatgtcgtcaatgctggcaatcaggcgttccatacgctccttttttgctgtcagcattttcctctgcatttgtaaaatctggttcctgtcaagagccgggttcgccataaccgctttgatttccttcaggggaatatcaaactcacgaaagaacagcacttgctgtaatgtttccaatgctttatcgtcataaagccggtatcccgcttcacttttgccagtcggctttaacagtccgatttcatcataatagtggagcgtgcgcacgctgatacctgttaagtttgatacttcttttactgtcctcatagctgtcggcctcctgttcttgatatatccactctaacccatgacgttccgtgagggtcaataggtaatttcaaatatttttgaatatatcacatttcaagaatggcgggaagaatttcagccagaatttcaaaacttgccagacttaaaatagatggcagtgcaagaagattctgtgcggcaagttcacaaaggggtagctggcaaagccagcgcaggggaaggacagcttcccctgtgatgattggagcagattggaaatctacggaaatcatctgctgtccgcaggacgcccccggcagggcgcaatgcaccacttccctaagtggtgtataattgcgccctctttcagagggggattttccagcttgtcgctttggaagccaaaattgcaagtggagtttatggcagttggaaatcatccgtaccaattacaccataggcggcataaatcagaacgcgcccggctcgttctgatttttacacatggaaagccgccaatgtgaacgcgctcggctcgttcacgttaagacttccctgcaaaaatcaagacgcgcccggcgcactttgattttggtcaggctttttaccgttcctgctgtttcatcttcttgttgggatagagcttcccggcaacaacggcggcatggctctttatcttgatttctccctcctgctcgctgcgttttgcgttccggtagccctcatcggagagatagaaacggaaccgctcccccttaaaaccgacaaagcaatctttctgtacttccagtgtaatcatgtggcgggtttctggtcggaaccgttcttttcctgacaggtcatgcccctgcatgattggctcctgtgcctttgccgccgcaagccgctggcggatggaattgtcacgttctgcaaggaaccgtgcttttgtggcggcgacaaactggctgcactccggctccggtatcttttccagtttccggatggcgttctccacgattgcctttgttaataaatcctttatcaccggcacgatttctttcatacccgcaagggtttccgccttggtcggtgcggcatactggtaaataatatccagctcgctttttgaaaatttcattctgtgtcctccttccggttttctgcaagaacctgttgcacaagcagctttgtatcattcctatgaaaaaatatctttaagatggcgcttacctgctcgtccgtcacggattccgggttggggagatggctttccagcattgcccctctggtgcatagccggtgcgtccgttccttccggttcagcgtctttatctggtgttccagcattttctccttatgctgcgcccgccgcagtttggcttcggtcttttcaatctcctgattgagcttttccagcttctcattcatgggcggcgtcctccttggggagcaggatatacatatggctgacctccccgatgccctggcggacacgcataatcatcccggcctgttccagctcgttcagtgaacgcttgcaggtctgggggcttcgggagagtgccgccgctatctccatgacggggaagcggataaacagaatcccgttgctgtcctcggttccccttgtcaggatttcatccaacaggcgggcgtacatgacctttgccgtattgctgaccggaagccggagcattgcctttgggagcggcatacagggcggcaggggcgtactggctatcataaattcacaattcattgattggtgtcctccttttggctcgtttagataaatagtgggggcagtcgataatgacagcccggaaactctgcttgcactcatgctggcatttccggcaaagtccgttgtagcttctgcgcccccggtcgttcaggaaaaaagcaagctctttctttaacttttttgacattctcggcatggtgcctcctccatagaaaaaccgcccgtttcagcaggtacagccggaatgggcggacagtggttttttgtgtatcatttcggggcgattttcaggggaaatacagccgtagagccgccccaaaatctcccttggtattacggacagggcagactatgccctgtgaaattgttgtgttttggtatcgtttcggtgttcattttgccggttccttctgctgtcgttcctgcccccgtcttaggcggcgtttcgctccgcttggtacgctcgttgcggtcagggttcctccatttccctgccggaagtcgttgcgttacatcgccggggagcatatcccatacaggccggtcattcgattggaataatccatcgatgaactgcctatatcatatgacatttttgtaccatgtgccgtatgtccacgaatcaggaataaagcccaaaatctgaaaaattccacgattgcggaaaaggctttctgccggacgggtgcaaaaatcagacgtgcattttgcacttctgaaaatccgggcaaatcaaaagcgcattttgcgcctttgaaaagaatcacaaagggaaatgcgcccggcatggatatgtggtacaatggggatggcggcaaaagctggccgcagggaaggagcaggaaaccatgaaacaggggataacgattcaggagcggttaaaggatttaaggacggagcggcatttaaaattagaggaactggcggcggctacaaagatttccaaatcagccttgggaagctatgagaatgacgaactcaaggaaatcagccacaaaaatcttgtggagctggcaaagttttacggtgtatcaacggattacctgctctgcctgacagagaaccggaaccatccgggcatggaacttacggagctgcatttgagtgacagcatggtggaactgttgaaaagcgggcgtatcaacaaccggctgctgtgtgagattgccacacatgaggattttgttaccctgatgacggacacggagatttatgtggatggtgtggcaaccgcccactttcaaaacttcaacagccttctggaagtcctgcgggggcaagtcctttcccaatatcagccggtggaggaagatactgcgttaaaggcgttggaagccatgcaggtacaggaagaagattatttctgtcaggtcacgcaccggacttgggacactatcctccatgccataagggaagcgcacaagaatgatacggacagtgcgccggacggctccaatggcatgaagctaatcagggacgcaaagaaggcgctggccgtgccgggttcctatctggatgtgttcactgccctgatgtgtacgcagctacaaatccggtatgagaagctgtcggagcaggagcgcacggttttgaagaatgttatgaagaaaactccggcatataaggattccccgttgagcaggatgaagcggagataaggaaatgccgttgcttgggatttttccatgcaacggcattttgagtagttttgatttagtttttagatatattagttggaatctaacgcttctttagctcggcaatagcaccataatgtaaaatatcaaattcattaggtgcaatatgttcaagaagtgttctatgttcttgttcccacatagaaatctctttttcggtaagcgaagcaccaattccacggcacgctttcattcttccattccaactttcatgggtaaatggtattcttagagtaaattcttcatgatgtacaaattcaaagttttctttgtagcaatcgggtatgtctatttgatgtatcgtttctcctgcgccactccaatttggattatattttaatacaagattttcactggctcctgcaatctcatcttcaaatggaagccatgccatatataaaacaagaatatttcctccttttttaagcatacgataaaacttaggcataacagtttcatggttgaaataccaaaaacattggcaggctgtgattacatcaaaagaattatctgaaaaacttatatcttctgttgatacaacataataatctatattcatatcttttgaaaggattttggcttgttcaatttgattttctgaaatatccgtagccgtccattttgccccatactggtacatatttctggggagaactcctgtccctgtcccaacatcaaggatagattgtccatttatacacaatttgcggtcaacaattttttgataaaattcttttggataaatatcacgatactttgcataatctaaagatgttttcccccaatcaaaaggtttaccgctatctatatctctattagttatcttcatcccatacctccatcaatgatttattgtctgaaataatcctatctcatatctacgaataaatcatctcattttttatgattgcctctgcccggctgcggatattgttcatccggcctacccattcaagctggttttgggctttcagttcctcggtcactccctcggcggctttcatctgctccatgattaagtccagccgttcctccgcctgctcgttcaggtcggcaaggtacgtccataatttcccggtcaggataagggagctgtaccgtgccgggtgttcctgtttgagatattcccggtgtagccgcccataacgtccgatggggcggttctcctccggcagcttcaagtccgggatatagtagtcgcctaccagaatatagtcaatgccgttctctgtgattctttctttcagtttttccattgtcgttccctcctgtggcggaaggctcgtcactggccagctcaatcacgtccataatgccacaatccagcgtttcgcaaatacgggcaagcgtgtccatgctgatgtgtttcccttcttttcccatgttggcaatcatatttgtggtcaggccagcggcaagccttaaatcctctttcctcatgttgcgctctatcagtgtgtgccagagcggtttgtagctgatgtgcatttttctccctgcctttcttccccggatgggcgtttgcacccattatatcaggattcttgccaactcacaaatatttcttgacggtatcgccggttccgtctggattgtgcttttcctttcctcttttgattacctctaattagccatgacctgcttcatggtttggggtggagtctgaattgtaaagatggatggaaaagtattgcatttggtgtgatgtggagttcgttgactccatactgccactgcagagagccgttgaagttcggcagttattcggtgggcttatatctgcctttctgtgtattaggtttgggcctttttgcagtttccatgatcgttcccaataatacggtttttttgcttgcagtcctgaatatgctgtctgcaggcggggaccttaccatcggatgttatcttctgaagcataaaaatgggctgatcctggatcacccaaccgactgcggatttatttcatttgaaaaataaagtattgtataaacctgacaagagacggactgatttttacataaagaatgatcaattcactaaaaataaaatttactatagtattctggggactaattgagtataatgagagcgaaaacagaaaatcaagagcaataatagtgataagtcataaataagatgggtatcttatggtatgccctttcgggtatacccgcaaaagtaaatcagaaaggaatcgaaaaatggaaaaaacattgatcacgatcagccgtcagcatggaagcggcggaaccgaagtagcgcggattttggcagacagacttggggtatggtattacaatagagagattttatacattgcggcagacaagattggatttgactccctggatgagcaggccatggaggagctgaactacaagaagagctcaaaatatatggaaggactgagtgtcatgatgggaactccaggccatattccggtgtataaccagatgtacaaagaacagggaaagatcatacagaagctggcaggctatggatccggcgtttttctcggaagatgcgctgactatatcttaaaagattttgagaatgtaacttctgtatatctctatgcagatgatgaattcaggcagaagcgtctttcagaagccgagggacgggaagttcctatggctgacatcaaaaaggaagataagactagagaatcctactacaattattacacggggcagaagtggggcgatgtgacaaactatgatcttgcgctgaacatggggaagatcagttttgaagaagcggcagatgttattttgtcatatattgaaaaacacagataattataagtgatgtctatcatgaagacagtatttagttaaattgacgagtgaagagcagggaatatggtcattagccctgctctttttctgacatatcaatattatggtaatgactgggaaggtatacccaaaagggcttcccgcattttatacccttcgggtgaacgcgctttgcgcgataaggtatacccaaaagggcatcccgcattttatacccttcgggtgaacgcgctttgcgcgataaggtataagatgatctacaacgcggtttatgatctcttccagactatttttatttggttgttgataggagaaattatttctaactatgataaaaaaggacagagccggttttgtccggcgctgtccttgaccacttgatacaggacctttaatcaatggtttccactgtaatggaattggaacggcagaaatctgtatactcttccttgggaagctgatccgtgaggatataattaatcttttccagcgggcagtaagtcatcagagaaaagatgccgaattttgagtggtctgccagcacatatcgctgcatgctgttggagacgacggcttcctttacccggtattcctcctcagacgcgtttgtcaggccgttttcaatggaaaggccggtgcatgccataaaggctttgctgatattaaaagctttaagatactcagagatcttcgcatccacaaaggagagggtttccctttttaagtagcctggaagggaaataacggtcagattcttataaggaagggctttcagggaaacctgcaggctgttggtgatgatggtgcagcgtttctctgaaatataatccacaatattgtggcaggttgtaccggtgtcgatatagataatgtcatcatcctcaatatgatcggctgcaaggcggcagatggccttcttttcttctacgaacttttcgtggcgttctgcaaaaggaagcagctttttcgacggaagagtgtcatttaatgtgactcctccgtacactttttttatttttcctgcttttgcaagcgtgtcaatgtctcttcggatcgtatttttggagacctggaaaacctcgcataaggtatccaaggaaaccgacttttcttttgtgatatactgttctatttcatcgattcgttttgtacgcatatgaaaactccctctcgtttattcaaatttaggcccagtctggccataaaaataaaagctttgttttattatagtatattatgagtaaattgaaaagaagcaattggtaagttgtgataaagtttaatgctaataactttagtccatacttttatcatcaaggaggtcttttcctgacattttttctgaggtataataaagcagaaacaagcaaccttaacgcgtgaagtacaagaatgtaagggtataaaacatgctgaaaggaacagtgggggacgggatgaaagaacaagaaatcaaattgatcgccatggatatggacgggacacttctgaccagccggaaggaagtgacacaaaagacagtaaaagtattagaagaagcaatggaccgagggatccagatcgtcccggctaccggacggtcagtgaatgggcttccgaaggagctgacggatcttaagagattaagatactgcattctgagcaatggggccagggtttatgatttacacgaacagagattgatttacaaaaaccagtttgacacagatcagatcctcaagcttttggaagcggtcaaaccgtaccatgctttccggagcatagcaaaggatggaaaggtatactgttataaagaagagctttataggctggaatcatttcatctgggagagtattccgaggagatgatccgtgcctccaggacgccggtagaggatttaaaagaatttatccaaaaggaaggcggaacttcagaaaaaatgacgctgttttttgaagaccaggaagaacgggcaaaggcgaggaaggaactgacagaatgtggtttatatgctgttgtggcttccttaaagaataatttggagatttctcttcattcctgcaataagggtgatgcgctggcccatctaatggagcacctggacttaaagaaagaaaatattatggcctgcggcgatgcggaaaatgattatcagatgatcgaggcggcagggatcggggttgtcatggaaaacggcagtgatgagatgaaagagattgccgattatataactgacgatcacaacagtgacggagtggccaaggcaattgaaacgttggttttgaaccgagaaatataaaaatacctctaaagcagttttggctgtctgccgtgtctgctttagaggtattttattgtaagagcaaccctattccagctagattcgttcaaaatcagaagcgccgtgtttacagatcgggcatacaaaatcggcggggagttcttcaccctcgtaaatatatccgcagattttacagcgccagccggttttctttgtttcctgcggctggggtttgatattcttgtgataatatgcgtaggtaacagaaggtatatttgataagacttctccgtctgtgacatcggcgataaacattgtgtgtgtgcccagatcaactgtctctgccacagaagcgctgagaaatgcgttcgcatattgacttaaataaataatctcgttggaggaacggtcatagccggagaaatccttcagcttgtcaacatccctgccgctctggaatccgaaatgcttaaaaatatcaaagggaacctcctcggacaggatggatacattaaaggaaccggtgtcccggatcatatcatgagtgtaattgcctttattgactgctacggaaatacggttcggtgtggtcgtgacctgctggactgtgttgacgatacaaccgttgtccttgtctccgtcttttgctgacagtacaaacaaaccgtagcttagttgaaacattgctgcttgattcatataaaaacccctttctatacttgatgagtattgtcaatatattcgaattataatccctttatgacacatttgcaatgcccgaatgggatattgctttacttttcagaaatgcgcggttataataaaacaaatgcgtgcaatgtgtcaaataaaaaggaaaagtgaggaaagcacatggcaggaacaatcaaagaaattgcagagcgtgccggggtctcccggggaaccgtggaccgggcgcttaataaccggggcagaatcaagccggaagtggcggagcggatcatggccatcgccaaagaattagactatcattctaacaggaagacaaaaaagaacacgcagaaagcggacaaaaatataaagataggggtcatcacccagctctcagaagcctcctttatgatccctgttaaagcggggatccgtgatgcagagcgggagcttgagtatctgggagtggagcttttattgaaggatattgaatccgtagatgaagaagcccagataaaagccattgacgaactggaagcggaggggatccacggccttgccatcatgccggtgcagtcagagtgtgtcagggaacggctgaaccgcttaatggaggaaaaggggatcccagtggtcacatttaactccgatatcgtgggcaccaagcgtgcatgttttgtgggactggataacaagaaaagcgggcgaaccgccgcagggctcatgggaatgctgacacgaggaaagggcaaagtcctcgtgatcacgggattctttaccaacagtgtaaacagtctgcgtgtggaaggcttcgtgcaggagatcaagaattcctatccggaaatggaactgctgggcgtccagagcagcttcgatgagacaaaggaagtggaaaagattatcgaaaatacaatggccattgcaccggatctggccggagtctttgtggcatccggcggacaggccggagtatgcctggcttttgagaagctgaagcttgaaaagaggccatatgtcatagtctatgacgccacgcctaagaatgcaaaagccctcaaagaagaccggtatgatttcctgatcgaccaggaaggctacgaacagggctacaggcctccgaacctgctttataacatgatccaaaaagaggaaatgccggagaaggaccatatctataccgatataaagatcaagaacaaatacaatgtgtgacatgttccacatgatttccgttcggctcttagaatgcctcactccaatcatgtagaacatggacgtagtatctgccggattaggttaccgcaagccaaaaggtgctatcctacgagagtttttcttcattgccggaaggagacctttccagagatgactggagataatgaagaaaaactcatacataataagtttcggaagtgtccatcctaaggttatactaataaccaaaggaaggagcggccggatgaattgccgattagagcttggcaggatcacatataaaaatgatgtgcagatgaagattgcggctcactgtgcgcaggtgtttgccggagttaaaccttcaaatgcggtgactctggacagggaagaaacaatttccctgacgcaggcgctgaaagacactggaattcaatacagactgttatatgccgatgcgaaacggtgcgtctggctgttgtacagggaacaagaccttgaacaatatctgatgaaaagagaacatcaaatatttatgagggattgtggatatgattctgttcagctaaatgacatgtttacggttttttgtaaaaactactgggagtacaaaaacggtagaaaaggatttccccatgaactgggtctgattcttggatacccgctgtgtgatgtaaaaggatttatccgacatcaggggcacagctatctgttttcagggtattggaaggtttacggaaacccggaggacaccagaaaacggtttgaagtttatgaccttgtgaggtatcaaatcatcaaacaggtacagcacaaaaagcctttggcgcagattgccgcttcctacaccaattacaggatccataaacaatattaaaaaatatacgcgcagggcacaccgtattttatatcctccggataggcgtgctacgcacgataaggtatactgtcagtttgatagaagagtgaaacacaaatatagtgtcttgctcttcttttttttgcgtgcatatgcgtgtcaaacgattgtgcaataatgactaagaagtctgtatacatttgtgtaatgtagcaaaaacaatcttttttataaaaagtgcttgcacataaatggcgtgcgtgatactataagcacataagtaaagcacataaaacgcatttgaaaaaagcaaagcaaataataaaacacgcaaataacacgcaatgtgcgtggaaaacaaaactgaggtgaaagttatgaagtatgttgaatttgaccagacaagaccaatggatttagtactcatcggaagggtagccatcgattttaacccggtagattatttccacccgttatctgagtgcactacatttaagaagtatgtgggaggatctccggcaaacatcgcagtggggatcacgagacacggaaagaaagcaggattcatcggcaaagtttccgacgaccagttcggagagtatgtagtagacttcttcaataaagagggaatcgatacatcccatattacaaaatgtacgaacggagaaaagcttggacttacctttacagaaatcctctccagggaagagagcagcatcttaatgtaccgcaactgcatcgcagacttacagttatctgtagatgacatcgatgaggaatacataaaaaacacaaaggcgatcctggtttccggaacagctttggcgcagagcccatccagggaagcagtgttaaaagcagtgatgcttgccaagaaaaatgaaacaaagatcatctttgacatcgattatagagaatataattggaaaaattccgatgagatttcaatctactattctttagtagccagagaagcagatatcatcatgggatcaagagaagaatttgacctgacagaaaaactgataaaaccgggcagaacagacaaagaatctgcacaggcctggaacaatgaaaatgcaaagatcgttgtcatcaaacatggcaaaaaaggatctacagcatataccaatgacggaaatgactattcaatcaaaccgttcccggttgaggcgttaaaaggttttggaggcggagacggatatgcatccggcttcttatatggagtatttgaaggatgggatatgatcgagtgtctggaattcggaagtgcggaagcggccatgatggtgagaagccattcctgttctgaggaacttccaaaccctcaggaagtcaaagactttatccgcgaaacaaaagacaaatatggcgaaatgattgcgagagtataggaggatatgaaaatgagtacaaccagaatgacagtagcgcaggcccttgtaaaattccttgacaatcagtatgtggaatttgacggggaagagacaaaatttgtagaaggtttcttcacaatcttcggacacgggatcgccgttggtctcggagaggcactggacagcaatcctgggagcttaaaggttcttcagggaagaaatgagcagggaatgtgccatgtggcgacagcttacgcaaaacagaacagaagaagaaagatcatcccttgcgcatcttctgtaggacctggagcggcaaacatggtgacagcagcggctacagccacagtgaacaatatcccgcttttggtagtgccctctgacacatttgccacgagacagccggacccggtgctccagcagttagaaaagagcgatagtctctctacaacaacaaacgacgcattcaaaccagtttgtaaatattgggacaggatcatccgcccggaacaactgatgacagccatggtcaacgctatgcgtgttctcacagatccggcagagacaggcgctgtgtgcatcgcactttctcaggatgtagaaggagaatcttatgatttccctgattacctgtttgaaaaacgcgtacacaggatcaccagaccttgcgcggtaaaagaagagattgaggatatagtaaaagttattaaagaagctaaaaatccgttagtgatcgtgggtggaggtgtgaagtattcagaggcaggagaaactgtagaaaagttctgcgaagactttaacatcccgttcggagagagccaggcaggaaaaagtgcctgcaagtcaagccacccttactgcttaggaggaatcggtgtcacaggaactctggctgcaaatacgatcgctgagcaggccgatgtagtcatcgcagtgggaaccagactttcagactttacaacaggctccaaaggacagttcaaaaaccctgatgtaaaaatggtaaccatcaacaacaacaaataccatgcatataaaatggatgcagtgaaagctgtcggagacgcaaaagtgacagtagaagctctttctgccagtctgaaagaagaaggatacaaatctgcttacacaacagagatcaaggacgcaaaggcagcctgggataaagagatggaccgccttgcaaacattgaatatacaggtgatgattttgagccggagatcaaagcgagagatcctcgtacgattcctgaattcgtaaaacttacagggggacttatcactcagactgcagcattgtgcaagattcgtgaggtcattgatgaagacgctaatattgtgacagcagggggaagtcttccgagctgtatgcagagaatctggactacagacaaacgaggcggatatcacgcagaatacggatattcctgcatgggatatgaagtggcgggagcgctcggcgtaaagatggcagagcctgagcatgaatcctatgtggttgtgggggatgccagcttccagatgctccacagtgagatcatgacagcaatgcaggaaaaacagaagatcaacatcctcgtatttgacaactgtggattcggctgcatcaacaaccttcagatgaatcatggagtgggaagtcttgcaacagagttcagataccgcgatgaaaacaatgagatcaagggcgatctgatcccggttgactatgcaaaagtcggtgaaggatacggacttaagacatacagtgtaagaacgatcaaagagcttgaggaagcattgatcgatgctaagaaacaggacgtagccacattgatcgacctgaaggtcattccgaaaacaatgacagatggttacaaatcatggtggaacgtaggtattgcgacaacttctgtgaaagaaagcgtgcagaaagcatgtgaaggagtattggaaggccgcagaaacgcaagacagtattagaaaagaggtatgacaatgggtaaagtattcggctatcctgagtttgatgcaaacggggaaaaggttttaacaacatatgacaatgattataaagaaatgctgatggatatccgcgtcttccgcttaaaagcgggagatgtgaagaccttctgcaaagaaaaagaggagaccgcggttcttttactaaaaggggatgtcgtattctcatttgatgaaacttccagggaagtcacaagaaaagatgtatttacagaaggaccctgggcagtacatatctgcacaggagccaaagtcacagtggaagcaaaggcagactctgaaatcttggtacagtccacaatgaatgaccagacatttgagagtaaactgtatgcgccggaagatgctccttggggatactcctgtgtaggaaagttcggaaatgttgcgaaacgccgtgtcaataccatctttgaccatgacattgcaccatactccaacatggtattaggtgaagtcttaaatgaccgcggaaactggtcaggatatcttcctcacagacatccgcagccggaaacttattacttcctgtttgaccatccggaaggattcggggcaagctttgtgggagaccaggtatttaagagtacagacggaagcttttcagcgattccagggggagaacttcatcctcaggcagtggctccgggataccagatgtatacttgctggatgatccgtcatctggaagggaacccatggcttcagacagacagaaatgaagatgaacgctacgtttggcttcatgacgcagaattctaagatagaaaatcataagaaagtataggaggataagaacatggcaagagaatttatcgcgccgggccagatttatactggtgagggtgcactggatatggcagaaggaaagttaggaactctcggcaaaaaagcgctgatcgtcacagataaggtgatggtcgagcttggaaacgcagcaaaggtagaaactgttttaaaaaaccagaacattgaatatgtgatctacagcgagatcaacggtgagccgaccgacacaatgattgaagacggactgaatctttacaaagaagaaggatgtgactttattgtcgctctcggaggcggcagcccgattgactctatgaaagcaatcggtgcactggtaaccagcggcggacagatttcagattacatgggaaagattatcacagaggaaacaccgacacttgttgcaattcctaccacagcgggtacaggttctgaggcaactcagtttaccatcatcacagatacaaaaaatgatatcaagatgctgctcaaaggcgctgttctaatgccggatcttgccatcatcgatccacagtttacaatgactgcacctcctaagattactgcggctacaggacttgacgccctgactcatgcggcagaggcttatacatcaaagctggcacagccattatccgatacatttgcgctttctgctattaaaaggatcttcaaatatcttccggttgcattcaaagacggaaagaatgttgaagccagagaacagatgtcaatagcagcactggaagcaggaattgcatttaacaatgcatccgtgaccttagtccacggaatgagccgtccaatcggtgctatgttccatgtggcacatggactttccaatgccatgctgctgaaggaatgctttatctatgcgctggacggggcttatgaccgttttggcgagcttggcaaagcgattaacgtggcggctgagactgacacagaccaggcagccagtgagaaattccttcaggcagttgtggatatctgcgatgagcttgaaactccttccttagaggaatatggaatcaataaagaagaatttttcggtgtgatcgacaaaatggccaacgatgccatggacagcggaagcccgtccaacacaagaaaagccatcacagcggaagatgtcaaagaaatttaccgcaatctgtggtaatcacaatgtagtaagtacgtgcgtttaacgtacttaaatatagatcaatgcagatttatgccactgaaactcctaaaaataaaaacaataagaataccccgggccaaaccctccaatacctggctcaaaaatgaattgttattgtgtaatatctgcattacaaaagtatggaccttttttctcctgggtccatactttttttttaaaaagcattgaattaatgaaaatgctatgctacaataaaatttgtaaataggatggtaattgattttgtcaagcttaacctgtctacataaattttttgtattaaaaatttatgtagacaggtttttttatttcaaaggagtagtttcaatgctaataaaacgagttttaacaaataatgcagtcattactattggagatgatggcaaggataagattgtttgtgggaaagggattgcttttaaaaaaagaagcggtgatgaaatcgatccttcattgataaatcaagtatttattttacaaaatgattctaatgtcataaaatttgaacaacttttaaaagatgtaccgattgagtatatcaggttagcttatgatatagcagaaatggctaaaatggaattcgcgaaaagctttcatgatagtatgatcgttactttaagcgatcatttatatacagcaatccagagatgtaaagaagggctgctgattaagaatgccttgctttgggatataaaaaatttctatgaaattgaatatgagatcggcttaagggcagttgagttgataaaagataaaatgaagatagattttccggaggatgaagcgggctttatagctctgcacatcgtaaatgcccaactggataaaaacagcatggaaaatatatttaaagtgacgaagttaattcaggaaataaccacgattgtaaagtatcattttcacattgaatttgatactggttcagcatattattaccggtttatcactcatctgaaatttttttcattgaggctgtttaatcatgatcaatatgatgaaaatgatgaaactgaattattggatatggtgattgaaaaatatacaactgcgtatgattgtgcaaaaaagatcaaggattttttgattcataagtatgactatcatctaaaagatgatgagttattatatctgacaatccatatacatcggattgtcacaaaaatgaatgcgaaaggaggcgatggaaaataattgatttaatttcactcagaggatggtaacattcagttggcttaaccttcaaaattcatatttgaaaacttagcaatgaaaaatggaggtactgtaatgagtaaatatgaaagtttagtaaaacacatcgttcaaaatgtcggagggaaagacaatattatttccttgactcactgtgtgacaagattgagatttcggttgaaagacgaaaacaaagcaaaggataatattattaaaaatcttgatggagttataactgtgatgcacagtgcgggacaatatcaaattgttattggcaatcatgttagagatgtttacgatgaagcatgtgccaagttaaatttaagcaaagataatcatcatcagaaagaaaagatgacattgaaagaaaagtttattgatctgctgacttctatttttatgccgtctatctctattctttgcgcatgcgggatgatcaaaggattaaattcaattctgcagtttgccggcgtctatacagacacgtctgggatctatactttgatcaacgctgttggagattgtatcttttatttttttccggtcgtaatcggatataatagcgccaagaaatttaagctgagcccatatgtaggaatgatgatcggtgcagcattatgctatccaacgatcaatggggttgatttggtggtttttgggataagcatgaatgtaacatatacatcaactgtactgccagtgatcttaaccgttgcactggcagcgcctatggaaaaatggctgaataaaattcttcctgaccttattaaatcattttttactcctatgattgttttattgagctctacaattttaggatttatggtgatcggaccaatcgctaattatctctcaaatataatcagcagtactttatcaggcgtctataatatgagtccgttattagcaggtgttttggtcggcggcttgtggcagataatggttgtatttggagttcatatgacgctcgttgttttggctattatgaatattgcggcaggaacaccggatccaattctgtcattatcggtttttgtagcctttgcacaatcagcagtagtattagcagtggcacttaaaacaaaagataaaaaattaaaatcggtttgtattcctgcctttatttcaggaatgttcggagtgacagaaccggcaatttacggtattacgttgccgagaattaaaatgtttgttatttcttgtattggaggggctgtttcaggaggatttgccggactggctggattgaaataccaacagatggccggtatgggaattttcgagattcctgctatgtttccaaaaacaggggtacagacagtgatgatccaggcggcaactgctactgtgatcgcatttgctgtgagttttgtattggcatatgtgttttataaagatgaagccaagatagaattagaaaaaatcaatatgccggtgaaaggcgatgtcaagccgttaagtgaggtgcaagatgacgcttttgcacagggtgccttaggagaaggtgctgcgattgtgccaagtgagggtaaagcatatgcaccatttgatggaactgtattatcactatttcccacaaaacatgccattggtatcgtgagtgacaatgggtgcgaagtattgattcatattggtatagacacagttaagcttgaaggaaaatactttgaagcacatgtggagcagggtgataaagtatcaaagggccaattattagtttcttttgacattgataaaattaaagaggaaggctattctacggacacattgatcataatcacaaattcaagtgactatgaagaaataaaaacagtaaatagtagtggaatcctgttggaagccacttattaggaggtggtgaaaaatgagttttccaaaaggttttttatggggaggcgccacagctgccaatcaaatagaaggtggatatcttgaaggccgaaaaggtgacagcatcagcgatcatataagtggtgggtcccgcagtattaaaagaagatttaccagagtgattgaggcagatacattttatcccagccatgaagcagtagatttttatcatcattataaagaggatatcagactatttgccgaaatgggatttaaggcttttcggatgtccatcacttggagcagaatttttccgaaaggaatagaagatgaacctaatgaagcaggtttaaaattctatgacgatatctttgatgaatgcctgaaacatggaattgaacccattgtaacgttaatgcattttgatatgccatattttttgttggaccattatcaagggttttgcagcagagaagtggtccgtcattttgttagatatgcggaaactatattcaaacgatataaaaataaagtgaaatactggattacttttaatgaaattaattttgcttgtttaccttccgggaacctggaagtattggggatttacgacgaccggaccacggattatacggacccttacgatgacttgaacaaaagatatcaggcgttacatcatgtattgatcgcaagtgctgaggcagtaaatgcagctcataaaattaatcccgataacaaagttggatgtatgatcgcccatgtcactttatatcccagaacatgcagcccaaaggatatgataaaggtacaagatttagatcatttatttaatgatttttgtggagatgtacaggtattcggtacatatcctgcttatatgaaaaattattataaagcacataatattgagattaacatagaagaaaatgacatggacattttaaaagaaggctgtgtggattattatacattttcttactatatgagcaactgtgtttctgctgaaggagattatgagacaagtgccggtaatttactaggaggcgttaaaaatccctatttaaagaacagtgagtggggatggcaggtcgacccgattggattaagatataccttgaacaagctaaatgaccgttatggtattcctttgatgattgttgaaaatggattgggtgctgtcgatgaattgactgcagatagaaaaattcatgatgagtatcgtatctcatatctgaaggatcacataaaacaaatgagcaaagcggttgatgacggcgtaaatctgatcggatatactatgtggagtcctatagatcttatcagttccagcactggtgaaatgaaaaaacgatatggtttgatttatatcaataaaaatgatgatgggatgggagattactcacggataaaaaaagacagtttctattggtataaaaaatgtatcgaatccaatggggaaatactctaaaaccaggatttcgcatagcttgttatttccaacatctgatggtaaaataagaaccatgaatcatggggattcagaaaggagtgtgtgcatacaatggaaaagaggtcgatttgtgtgaaaaatatatgggaaaatttccggtgatttctgtctcattaaaaggtgtaaacggagacaacttcacaaccgcccgttctatgatgtgctccgttgtcggaaatgaagcgctgcggtttgaagttctggcaaagagcaggcaactgtcaaaagtggataaaatgcggtatcatgccttgatcaatgtggatgacagcggaaattttgaaatgtcggatgaagtgctgatgaacagccttttgaccctctccgctcttcttcaaaagcattatgggacaaaagtcattattttgattgacgaatatgatgtaccgctggcaaaggcgaatgaaaaggattattatgattcgatggctgcattgatccgaaatatctttggtcaaacgtttaagacaaatgaatcacttttttttgctgtgctgactggatgcctacgcgttgcaaaggaaagtatttttacaggaatgaacaatctgaaagtcttatctattgcagatgtccgttttgatgaatattttggatttacggacaaagaggtgagaaaaatgctggaatactacggacttacagatgcctatgatgctgtgaaggaatggtatgacggatatcggtttggaagtattgacgtatactgtccgtgggctgtcattagttattgtgacgagctgggggcagacaaaatggctgttccgaaagattactggtcgaacacaagcggcaatgatgttgtgagaaattttattgagaaggcgggcacagggacgataaagcgagagattgaaaggcttgttgcgggagaagcagtatcaaaagaacttcatcaggaactaacctataaagaattgtatgattccatagataatatctggagtgttttatttaccacaggttacctgacacagcgcgggaaagcaatgagtgatacttttcagttagtgattcccaatatggaaatccgtaagatatttacaaggaagattatagaactgtttaaggaaaatgtatgtaaaggtggagagacattaaatatattctgcaaagtgttgaaaaatggtgatgccaggggtgtagaaaatcagtttacagaatatttaaagaaaacaattagtattcggaatacatttgtaagaaaacagacaaaagaaaatttttatcgcggcattctgttggaaattttaggatttaaagagacgtggagtgtagcgtcaaacaaggagtcaggggatggctataatgatattcaggttgagattgatgacgaagaagttagaattattattgaagttaaatatgcccatgacgctgatcttgatgctgaatgcaggaaagcattagaacagattgagaaaaatagatatgcagacaggctcttagcagatgggatgcagaagattttaaaatatggcattgcatgttataagaaaaactgtaaagttataatcaagagatttctattcaatgataccggccaacagtttaattgttgaccggtatcatttataaaataatcaaagttctccggtgaggaactgtgcctttccaaacccaaaactccagtccgcatccccgttttccacgatggagacaagaagatcctgggggttgatctggcaccggtcttttaaccgccggcagagcagagtatagagcagttcttttttatcccgggttctctgtttgcttgtgacccggatgacgatctggtcctttgtccgttcaaatccaaggcctgtgtctaacaggatcatctcttccggttcatgctgatttacaatctgatagcggtcgcgctcggggatttcaaaggcctcaacagcgcactgatggatcgtgtccagaatatttttaagtctcgctttatcgttttgttttaacagatctacttgaattaatggcataatagattcctttctttctatgattgacatataaaatgaatggtgatattataacagtaaaaattaattagcatacgaactaatgggatgcaaattaatttgtatggttatcatagtataccttatcgcgcggagcgcgtcaagcccgaagggcataaaacacgggatgcccttttgggtacagcatttttgaagagtcagctttaatttatattaaagaaatttttacaaaatattacgtcggtgaagggagtgaaaccaatatgaggatcttagtgtacttaaaagaaatacctccggaggaagagcgggatcaataccaggatacagaaggcctcaatgacagcgataaaaatgtcctgatggaagctctgaatctgagggatgaagaaggaggaacggtgacagtcatgaccatcggaccgtccagggcggaaaagacggcaagagaggcattgacctggggcgttgaccggtcgatcctggttttacaaggaaggaacgggacagggaatgtccggaagagcgccaggctgcttgcaagagccatagaggccgaaggggcatttgacattgtgttatgcggcaggcaggctctcgacggagacgcggcacatatggcggctatgacggcattttttctaaagatccctcttattgcgtattccagaagaatagaagcagcaaatggaaagctctataactggtgcatgtcagagaatgggacagaacagacagagtgcagcatgccggcactggttctttcagtgaaggagaatcagaaaataaggcatccgaatgttgcagatattatgtcagcctatgcggaaagtacagccattcccgtttttggaacaggacaaagtgagaccgaaaggatgatccaaaaggtcagagaatatacaccaaaagaaacgccgaagaaaagaaagctgctggatgggaaagatgaacaggaattggcagaaaagctgtatcaggtgctgagagagcaggacgttttggagtagagggagagtcgtatggagagatcaagaaagatactgatcattggagaaatacaaaatgggaagccggttccggtgacattggagttgataggagagggaaagaggcttgcgtcttttacgggcgccagactatttctggcagttgcaggcagcgggatccggggaatctgcagggatctccttcggtatccggtggacaggatcatagcgatggatcatccaagattggagcctgcacagctggaggtccacggcaaggtgatggaagtcatgatccgggaacaaaaaccagatattgttctgggaggagggaccttatttggaaagacgctgatcccctctgtggcagcagctcttggaacagaagttatgacagatgccgtcggcctggatatcgacagagagacaggaaggttacttgccataaaaccggcctttgacgggaagcagatgtcagtagtgtcaatgcctgaggctgaggtacaaatcgcttctgtaaagcctggagtctttcagaaatctgatgagacggacaataaaaaagggaacattactatgattccggcagactggctggaggatatcaaagagcagaaaaaaactctggattttatttttgaaggagatcaaaagatttgtctggaggatgcaaagatcattgctgccggaggacgggggctgaaagggccggaagggtttgaacttctgaaacggtttgccgaccgcatcggcgctcaaatgggctccacaagaccgtgtgtggatgcagggtggaccctgccggagcagcagattggccagaccggttccattacgaaaccggatctttatctggcatttgggatttccggtgcaatccagcatatgaccggagtccgggcaaagactgtgatcgcagtcaataacaacccgaatgctgctatttttcaatactgtgactatggaatcgtgggggatgcccaaaagatactaaaagaatttctcgaaaattaaaaagaagatccggtatttcacggatcttctatagataagtttataatccaaaagaagctaaaacaataaatattccgcaggatataaatggtatgataatctgcgtaaccgcaatatcccagtaagcttctttgtgggtcattttacagatgccgagcagtgtgatctgcgctccctgatgaggaagtgtatctaaagtaccggctgcgatggcagaaatcctgtgtacataaggcagagggattcccattttaatataggtagacttcaaagcattaaaggcaacccccataccgccggaagcagaaccgcaggctcctgcacagacagccacggtgatcattacaaacaccagaggcggcatgctcatatctttcagagcggcaaccaggtcggtaaagccctgggtcttctggactacgcctccgaaaccgacaacaattgcggtattcagaatcgcaacgccggagtcagaagcacctttgttgaaaacgttgatccattcgttgattcccttgatcctgttaaacatcagaatggttgccagggccacacctgcaaatacagatgtttccacagggagcttcacgatgttgaagagcaccagaatgagaacgatcggaagaacggcgatggcaacgtgaggaagacttttatcttcatcgatggccatctcttcttcactcagctgatattttaaggacttatcgatgaaacgatatcccctttttgtaaattttcttgcgcgcatttccagccagacaaagatcatggcaaacatagccacggtcgtaatcagggatggtacaaatgcggctgttgccggtgtgccgaggttatccatggcaatgacattctgaatagaaggagagccgggaccgctcatggaccaggtccagcatccggcagagattgccgccggaatgagccttctcgtaaggttcgcctctttgaaaagattcagtgcgattggatagataacaaagaatacaacgaagccactgactcctccaaaagtcaaaagaccggtgatgatcatgatgatcggtgccacgaacttcccgcggcagaggcctgcgatcgctctggcaatcgattctgcggctccagtatactggtaaacagaaccaaaaagtgcgccgacaaagaagacaaggaaatactttgtcacatagtcggatgctgcaggcataaatgcgtttttcagcgagtccaggattggaagcctggagcagatgaccacgaagatcgtgacaagcggagccaggatcaaagcactcatctgtttaaatgccagaactccgaacaggacaatcgccaggactaagactaagatttgtaaattcacaaaaaccctcctttatttgtggattgttaatcgtgtttcaggcccatcagctcatctctgaaaattctttcatccatgagttttggcgtaccgtccattttaggagtgaatcccatatggtcgatgatctgtgtctggatatcgatgccgggtgcaacctctgtcagatagacaccgtcttttctgagttcaaagacagcgcgctctgtgatatagagaaccggctggccgactttatttgcgtattcgccgctgaatgtgatctgttctaccgtgtccaggaacttattagattttccttcctgatcaatgataagctttccatcttttacagacgtttttaaaccgccggcagtaaaggttccgcagaagtagcagcgttttgcattctgagtaatgtttacaaatccgccgcagcctgcaatcctcggaccgaacttgctgacgttgatgtttccgtctttatctgcctgtgcaaggcctaagaatgcatagtcaactccgcctccgtcatagaaatcaaactggtacggctggtctaaaatacattcgggattgacggaacctccaaatttggctcctccctgaggcacgccgccgacaggccctgcctctacggtcagagtcatataatctccgatgccttcctcattggcaaccatagagatatattcaggaataccgattcctaagttgaccacggtattttccgtcagttccatggcagctctccggccgatgatcttttttgcggaaagaggaggatattcaaggctgcttaaaggaatacggaagtctccggtcattgcaccgtcatagtcacatcctacacactgttcgtggtcttgcatattttccacttccacgactgcatccacatagattccggggatcttgactaattttggatctaaggtaccgtctgcgacgaccttttccacctgcaccacaacttttccgccgctgttcttcactgcctgagccatggttgtgacttctgttgtacagcattcatgggaaagtgtcacgttgccgtgctcgtcagcatatgtaccccggatgaatccgatgttcagcggaaaagatttatatagtaatttatcttctcctaagatttctaccacatctacgatgtcctcggtcgtaatgtcatttaatttgccgccttcaatgcgcgggtcggcaaatgtatttaatcccacatgagtgatcacgccgggtttgtgaccggcgatggcacggtagagctgtgccagagtgccctgcggcagattgtatccttcaattttgttatcaaggaccagctgtccaagcgtcgggaccatgttccagtgtccgccgatgacacgtttggtcattccttcgtgggcaaaatgatccgcaccgcttccgtcacggtttccctgggcagcagcgtaaaataaagtcaggtttttcggagaaccggtttccaaaaatcttttttccagagcttttgtaagggcttccggcattccgctggcaacaaatccgctggtagtgacggttgtattatcttctaccagggcagcggcctgatctgctgtaataatcttaacttttcccatagtttttctccttcatttattttagaaatcttttaaatctgctttgcgtttttcaagaaatgcagtcatgccttcttttttgtcttccgtagaaaatgcgagtccgaataaatctgcttctaatgtaagtccgctgcttaaatcggtgtccatgcctgtgttgatcgcttcttttgcaagagagattgcatagcttcctttggacatgatcttagctgccatctttttgcagtaatcaatcagttctgcctgaggaactaccttgtttgcaagtccgatcctgtaagcttcttcggcgtcaatctggtcacaggtaaagatcagttcttttgcacgtccttttccgactaagcgggagagacgctgtgttcctccgaatcccgggaggattccgagtcctgtttccggctgtgcgaatcttgcattttctgcggctacacggatatcacaggccatggagatctcacatccgcctccgagagcatatccattgacagcggcgatcgttacctgaggcattgtctctaatttaaggaatgcttcctttgccagcagacccatctgtcttccttccgcaggagtggcattgaccatttcagaaatatcggctccggctacaaatgatttttctcctgatcctgtaaggataacgactctgatgtccttgcggcgggagatctcggaaaagcactggtctaattctgctaatgtctcactgtttaaggcatttaaagattttggtctgttgattgtaactactgcgatctcgttttctacttccattaataaattgttcattctaaatcctccttgaaatgacatatacattacacttaatcagctcttgttagaaaattaacatattggcgtgcaaatatttaggatacaaaatattatttatgcttctaatatggactatatttgcatgtttgtcaatggtttatcaatatattttatttaaattgtataattctataaaagattataaaagtttattgacaatatgcacaaggggtgatatatttagcttacaaaatattagtatgcaaatatagggaaacaaaatggtaaatttatgttaagtttggtgaaaggagtgattatttatgaattttgaattaacggaacagcaggcagccattcaggagacagcaagaaactttgctcagacagagttacagccgggagtgctcgagagagatgccaacagtgaatttccggtagatctctataagaagatgggagaactgggactgatcggacttccttatccgaaagaagtcggaggccagggagccgattacctgtcttatgtattggcagtggaggagatctctaaagtagatgcttctgtgggtatttcttattctgtatccacttctttatatggaggaagcatcatgaactctgacgctccggtcgagaaaaagaatgaatttctggcgccggtattgtccggacagcacttcggatctttcggactcacggaaccaaatgcgggatctgatgcgggcggatgtgtaaccgttgctgaaaaagacggggatgagtacatattaaacggtatgaagtgtttcaatacgaatggacctttagccgattatacggcagtatatgccctgacggaacctgagaaaaaagccaagggactgtcctgtttcgtggtgaagaaaggaactcccggattttcagtgggcaaagtggaagacaagatgggaatccgttccgcgcaggtttcagagatgatcctggaaaatgtacgggtgccggcagaaaatatgatcgttccttccggagacggatttaaactggctatgaagactctggacggaggccgtatcggtgttgccgcacagggacttggaattgcagaaggtgcatttgagattgcaaaagaatacttaaagacgagagagcagttcggcaaaccattatacaggaaccagtatcttgcatttaagatggcggaacttgaaatggaaattgacgctgcaaagctcatgctttataaagctgctaccgacaaacaggaaggaagaccatattctattccggccgcaaaggcaaaatacctctgtacagaggcggcaatgcatgtgacaacagaggcggtgcagatgctgggaggaaacggttacatgaagggataccatgtagagcgcatgatgagagatgccaagatcactcagatctacgagggaaccaacgagatccagaaactcgtggtcagcggagcgattttcagatagtctgtttttggaatatgaatcctaagttttcagggatgtcaattatggcatccccttttcatgctttacaaggatgactttgctttaggataaaagccttaaaattatagtatgtcttcttgacagaagtttttgtaacagatatgatgaaatatatagtatgcaaacagtttgaagtgtttgcatgtagttttgtgtaggagggaaaaggaacggatggaattgaatcaatgtatcaactatcttttgaccactgcccagcacgcggtgtttcaggagatgagcgcacagctctctaaatttgacgtgactccggtacagtacggtgttatgtactgtctttgggtgaagaagaaaaacagcccgaaggagatcgcagaagaactgaggctggaaaactctacgatctcaggtgttcttgagagaatggagaaaaagggattgatcaagagaaaagtcagcaaagaagaccggcgttttgtagagattatattgactgataaggggaatgacttggaagaaccgattctggaaacagtggaagaggtcaacaggatcgtgttgaaagatatgggacagcaggagcaggaagcgctgaaggcatccttaaggcatctggctgggatctgagctttaaagattttataacgaaagaatatgcagcagaaaggagcctttctggctgctattttttgttataaaatattattagattatgtttatgaggattagatttaatggtagttgatatagttatatatattgacaagatgaatttgaaggaatataataacataaattataaaaaatagaattatattgaaaaattataaaaaaggaggaaataataaaaatatgaaagagaatctattatttccagtaatttatatattggtattatttttgagtgtttattttcagtatcatatatcttcaaaaaatatcaaaaaggggagaattatcccctttcttttaattgcatttatcgttgttatttggattacaaatggttttgacgtaatgaagtgtttacctgtatctataattttaggatttatctgtattatcaatatcctgatatggattttttcatatcataaatactgaaaccatttttgaaggaaagtacactttgaaagatgggggagctacaacgattacgcttaaagatgaaaaggaacacgaactattatcaacgggatcatatacaaaaaatactatacgaacgaaaaaatttggaaacaggatgtttacagcaattgttgttgttgaacataaactttatccggactctaagcttcatcttaaatttcattattccattggaaaatacggattaagggcaagatatgccgaatcaggttctgattcgtttggagtagtcacggtgtcagaagggacacctaaaattactgacaaatatgctcaaaaaaacggtaatgatattaatgctgtttgcagttataaagtaagtatttcatcaatattattaagacccattatgataactcataagggtcttttttctttatatggatgtgcagtcataatgaaggttcgacacacctttcttttcattcactgttttgctaaaatagatagaaaagatttcatatgacagataagttgagaaggaggcagaacatgtcagatcagattaaccggcagctgtttaagtttattgaaaaaagtccgtgcagttatcacgctgtggagcagatcaaaaaagagttgaccgaaaatggatttctggaactgagagagcaggaggcctgggaagtagaaaagggcggtaagtattttaccagcagaaacggttcttctttggctgctttctgcgtaccggagaaaaaattaaaagggtttcatattaccgcgtcccatacggactcacctgcttttaagataaaagagaatgtggaattacaggcggaaaagcattatacaaaactgaacactgaaaaatatgggggaatgctgatggattcctggcttgaccgtccactttctgtggcaggaaagatcatcgtgagagacggggaaaaacttacggaaaagctaattcatataaagaaagatctcttaatgatcccagggctggcaatccatatgaaaagaggagcagaggatgacacactgaatccccagattcatatgcttcccgtcttcggagaccagacagccgaaaaggcatttatgcggacagctgcatccgaggcgggtgtaaatgaaaaagatatcctcggtacagatctttacctatacaaccggatgccgggaactgtatggggagcaaacggcgagttcatgtcggcaccgaggctcgatgaccttcagtgtgtattcgcatctttgcaggcttttgtcaacagtgagggaaaagagtatatgaatgtcttttgtgcatttgacaatgaggaggtcggcagcggaacaaaacagggagccggatctacatttttagaagatgtcttgtggcgggtaaatgaggcgctggggagaaccggggagcagtaccggatggccgtggcggagagcttcatgatctctgcggacaatgctcatgcggtgcacccaaaccagcccggcaaggcagatcttacaaaccggccgtatatgaatgaaggaattgtgatcaagtacagtgccaatcaaaaatatacgacggatgcatactccggtgcgatgatgaaacatatctgcgaaatagccggagtcccttatcagaccttccacaaccgttcagacttgccgggaggctcaactctcggaaatattctgacgggcagtgtatcgttaaaagccgtggatatcggccttgcccagcttgccatgcattctgcctatgagacggcaggagccagagacacagaatatatgatcagggcccttcaggaattttatcgcggttaagggaggcagattcagtgaaacagcataagaagatccagatgtccgaggcctttcagctgggtgccgttttggctgttgtcgggggatttctggatgcgtacagttatcttttcaggggaggggtgttcgccaatgcccagacaggaaatatcgtactgctgggcatcagcctgcaaaaaggaaagtggcagggggctgtccattacgccatccctattctggcctttgcggccggagtcattgtggtggaactcatcaagaagtattttaaacagcatcccaaaatccattggagacagatcattgtcatgattgaagcggcgatgatctgcctggttgcctttatcccttcgggagaagcggatatgatcgccaatgttatcatttcttttgtctgtgccatgcaggtggagacctttcggaaggtacacggaaatgtctatgcgacgaccatgtgcacaggaaacttaagaagcggaatggaaatactgtttaaatacttccagacgaaagaccgggaactgctgaacaggagcctgaaatactttgggattattttgtttttcatagtaggtgcggcagcaggcacggcggcaggaaatgtgctttctcacaatgccgttctgatctgttctgcacttcttctggcagtatttttcatgatgtttatggagacaaagaaaattaattgataaagtgttgaatatccaacagatttttaaggctcactcctgtatactcaaggaacaaactcaaatataagaaatttcaggaggatagagcgatggataaaaagatgttttgttttcagtgtgaacagacggcaggatgcagcggatgtacaggagcagcaggggtctgcgggaaagatgcagagacttcagaactccaggaccggctgaccggcgctttgatcggccttgcccgttccgcagaaggaaaccggacttttgacagcacggacagagccatgctgtcaggtctgtttacgacagtgaccaatgtgaattttaacccggagacgatcaggaagcagatcagtctggtgcacagggagaaagaaaaattagtgccttcctgcggcgggtgttcttcaccctgtgggaaaaacgatgactatgtgatgaagcagctctgggaggagcaggaagatatacggtccttaaaatccctgatcttgtttggactgaggggaatggcagcctatgcttatcacgccatggtgctgggctattcggatcagacggtaaaccggttcttctatgaaggcatggcatccataggctacgatcttcccaaagaacggcttttatcacttgcactgaagcttggagaagtgaatttacagtgtatggaacttctcgataaggcaaacacagaaacatttgggaacccagagcctgtatccgttccttttaaggtggaaaaaggaccgtttatcgtcataacgggacatgatctttacgatctgaaacttcttttggagcagacggaagacaaggggatcaatatttatactcatggagaaatgctcccggcccatgcttacccggaacttaaaaagtatcctcatctgaaaggcaatttcggcactgcgtggcagaaccagcagaaagaatttgaccatatcccggctccggtgctgtttacgaccaactgcctgatgccggtaaaaccgtcctatgcagacagagtctttacgacggaagtcgtctcctatccgggaatgattcacatcggtgaggacaaagatttcaccccggtgatcgaaaaagcgctggaactgggagggtatgcagaagaaagagaatttacaggaatcaacggcggcagcagtacggtgaccggctttgggcacaatacagtactgtctgtagcagatacggtcgtggatgcggtgaaaaagggcgagatcagtcatttctttcttgtcggaggctgcgacggggcacacaaggagcggagttattacacggaattcgtaaaacagactccgaaagacagcatcatcctgacgctggcctgtggaaaataccggttcaatgatatggacctgggagagatcagaggactgccccggatcatggatatgggacagtgcaatgacgcatacagtgccgtcaaaacagcccaggctctggcagaagccttttcctgcgggatcaacgacctgccgctgaccctggtactgtcatggtatgaacaaaaggcggtatgtatcttgctgactcttctttatctcggcatgaaggatatttatcttggaccgaaactgccggcatttttatcaccgggcgtactggatatgctggtaaaggaataccggatacatcctgtttcagacccggaaagtgatctgagagaaatactgggttaatgattcaatactttttcacagaaggaagatctttatcaagggatcttccttctgtttttttaccaacatttaacatgatgttcaaatgaattcaaactttcggtgatagacttggtcttgttcaaagaaatgatatcgattgagaaaggaatggaagtttatgctgaaattacaaaatataaagaaatcctatgacggcactacggtgttggacggaatatctctggagattccggatggagagattgtttccatcctggggccgtccggctgcggaaagacaacacttttaaatatgatccttgggatcacggaaccggacagcggaagcattgagtttaacggaaaggatatcactgattcaccgatggaaaaacggggattcaatatcgtgtttcaggattatgccctgtttccgaatctgaatgtatatcagaacattacttacggactgaaaaacaagccggacatctcttcaaaagaggagctggaggaactgatcggcctgcttggcctgaaggaacatcttccgaagaagattgagcagctttcagggggacagaagcagagagtggccctggcaagaactttggtcatgaagcctaagatccttctcttagatgagcctttaagtgcactggacggagtgatcaaggaatctattaaaaacagaattaagacgatcgcgaaggaatttcatctgactactgtcatcgtgacacatgacccggaagaggcgctgactctgtctgaccgggtgctgattgtaaacgagggacggatttcccagtacagcgagccggaacagatcgtcaacgcgccccggaatgactttgtgaagaattttatcctgaaccagctggagatcaaaaaaaacaatatttttacgctgtttaaaaatcagctgaatatacagcccggaaaggaaagccttgtttcgtaaggcggcagaaatcagatgaaacatagaaaagaaaaagagattaaagtcatatttgccgggatcgcactgatctttcttacatttttagcagtcccgatggtacagcttcttatgaagtcgtttaccacagaaggaggaggacttaccttacagaattttcagtctgtttttgcgcgggaagacttttttgagattttgagaaacagcttcggcgttgccggactgagcgcggcagttacgaccctgctggcatttttcctggcctgtacgattcactatacaaatataccggactggatcaaaacattgataaaaggagccgctgtgctgcccatgtttctgccgacgatcacctacggttttgcgatcatatactctttcgggaaacaggggcttctgacccgtctgttcgggaagcagctgtttgaaatctacgggatcagaggccttttgatgggctacgtcatttatactctgcctatctcatttatgctgatcaataatacgatgggctacatagataaaaaatatatgattgtgtccagagttatgggtgacagtgcctttgcaaatttcaaaatgacagtgcttcgtcctcttttaggtacgctggccgcatccgtgatccagtctttcttcttgagttttacggatttcggtattccggcggcagtgggaggaaagtttaagaccatcgcatctctgctttacagcgagatgctcggcagcataccgaatttccaaaacggcgcggtagtggctgttgtaatgcttgtgccgtctgtcgtcagcattacggttttaaaaatattggagaaataccagattcggtataacaagatttccaagatcgaactgaaaaagaacagagtcagagatggtttatgcggcggggtcagtattcttctgatcgtcagcgtcttatctgtatttgcagtcatttttgtgattccatttgtggaagaatggccttacaggcttagttttacactggacaatttcagaaatgtctttgaggacccgaaccttttcaatgtctacacaaattcattgtttgtagccgcggccacggctgccctcggaaccatagccgcatatggaagcgcgctggtgacagccaggagcaagatcagccaaaaggcaaaagacatgatagaaggaattgccctggtgacaaacacgatacccggaatggtgctgggcctcgcatttttattcttattttcaggcaccggtcttcaaaatacatttttgctgatcattatctgcaacgtggtccactttttttccacgccttatctgatgatgaagagttctctggggaaaatgaacgcctcatgggagacaacggcgatgctcatgggagacagctgggcaaaaaccattttgaggatcgtaacgcccaacgcattgagtacgatcatcgaggtattcagctattactttatcaatgccatggtgacgatcagtgcggtcatctttatcgcaggggccaggacaatggtcatcacgacaaagatcaaagaactgcagtattataacaaatttaacgaagtatttgtgctttctcttttaatccttgcgacaaatattatcggtaagtttgcatttaccaagcttgcaggggtcacagaaggaggagcggctggacaattctttaaattacatattagaaaaaacaaggagagaagtttatgagaaagacatggttaaaaagagtatcagtgatgtgtatggctgcccttctgacagcgaccggagtgttcacttccgggtgttccgccaaaaaacaggatgagcaggtagtaatctattccaacgcggacgacgaagctgtggaggcaatgaaaaaagcactggacggaaacggatacaaagggaaatatattcttcagacgtttggaacctcagaactgggaggaaagctgatcgcagagggcaaaaatatagaggccgatatggtgacgatgagcactttttatattgagagtgcccagaagaaaaacaagatgtttgcggatcttggtttcgacaggaacttaaagaaggaatctgattttcagaaatatgagtctccgatcacggcacaggaaggaacgctgatcctgaacacggaagtaatgaaggagaagaaacttccgaaaccggagtctatcaaagacctggcaaagcctgtgtataaaggatctatttctgtgacggatattaaagcatcttccaccgcatggcttttaatccagggtcttgtgtctgaatatggggagaaggaggcaaaaagtatcctccatgacatttaccagaatgcaggagaccacatcgaagattcaggctctgctccgatcaagaaggtccgggcaggggaagtggccatcggattcggtttaagacagcaggcggtggcagacaaaaaggacggtcttccgattgattatgtagacccgaaagaaggaaacttttctctgacagagtgtgtttccgtagtggacaaaaaagacagcgacaagaaagaacttgcccttgagatggcagagtgtattatcaaaaagggaagaacagacttgatcaggacttatccgatcccgatttataatggcgaagacgaatcaggtgaaaataaatccggaaatccaaaagtatttaaagaaaagctgactttggatcttctggaaaaacatcagagattatcagaaagcgcaaaataagagaaaggtataaaaatgaaccagtataagctattaacccccggtccgcttacaaccacggacactgtaaaacaagagatgctttttgatcactgcacctgggatgaagattataaaaacatcacccagaagataaggaagcagctgctttcccttgctcacgtgtcagaggacgactatacggccgtcctcatgcagggcaacgggaccttcggtgtagaatccgtgatcaccagcgtgataaatgaaaacggaaagctgttgatcattgccaacggtgcatatggggagcgcatggcggacattgcagagcatgcagggataccttatgaaatttatcgggaagattatagaaaggttccccgggcagcagttgttgagaagatactgagagaagatcctgcaatcactcatgcggctatggtgcacagtgagacgacttccggcattctcaatgatattgaggccattgcttctgtggtgaagaaacacaataagatattgattgtcgatgctatgagcagtttcggaggcgtggacattgaagtcggacaattaggcattgattttctcataagcagcgcaaataaatgtattcagggtgtcccaggcttttcttttattattgccgataaaaagaagctgtcagacagtaaaggaaacgccagaagcctgtctcttgacttatatgaccagtgggaaacgatggagaaggatggaaaatggaggttcacttcccctacccatactatcctggcctttgcaaaagcgcttaaagagctggaatcagaaggcggaatcccaaaaagagcggcccgatatcgggaaaataaccgtattttgatcgaacggtttcgctcaatgggcatgctgccttatattgacggcactcatcagggtccggtcatcactacgtttttgtatccggaagatgcagattttacgttcagtgagatgtatcattatatcaaagagcgcgggtatgcgatatatccgggaaaggtgacggaagccgagacgttccgcatcggcaccatcggagaaatatacccggaggatattgagaaactctcagaaatcatggagcaatttttaaaggagaagaaacaatgagcagatgtatagaagcagtcatttttgactgggccggtacaacggtagattatggatgttttgcaccggtgcaggctttcgtggaagtgtttaaacattttgggatcgaaccgacgatggatgaggtgagagaacctatgggaatgctgaagatcgatcatatcaggacgatgctttccatgccgcggattcatgatctgtgggtgaaggaacatggatctgaaccttccgaggatcacgtgcttcagatgtatgatttatttgaatccaaacttatgagtattttagaccagtttacaacgctcaagccgtatgtgacggaaacggtggagtttctcaggcagaagaacattaagatcggctccacgaccggctatacggatactatgatggaagtcgtgacgaaaggtgcaaaggaacagggatatgagcctgacgcatggttttcaccggattccacagaaggaatcgggcggccttatccatatatgatatttaaaaatctggaagctttgaaggtttccacggtaaaaaatgtggtgaagatcggagatacggtttccgatatcaaagaagcacggcatgcgggtgtcatttctgtgggtgtggtggaaggaagctcagagatgggactgaccaaagaggaatacgaaaatatgacagattcacagaaggaagctgtgtgcaggaaagtaaaggaaacctttaaaaatgccggtgcccattatgtaatacaaaatttgtccgaactggaggagctgctgaaaaaactgactcaataaaggtctttatgttttcgataagattgcatataatatagaaatatgaaataataagtcatatcatttaagatatggcttatttagttttaacaaaaagcaataaaggagtgggatatatggaagctttaaagtgggcggccggaggtacgggatttacatttttgatgacagccctcggctcagccactgtttttttcttaaagaaagatgtgcaggaaaatatgcagagggtctttttggggtttgccgcaggagttatggtcgcagcgtctgtatggtccctgctcattcctgctatcgaagaggcagaagctaatgggcagataggctggataccggctgccggaggctttatcctcgggggagttttcctgcttttgatggaccggctgatgcctcatctgcatctgggggagaaacatccggagggactttcctcctcgtttaaaaggacgaccctgctcgtccttgccgtcactttacacaacattccggagggtatggctgtcggtgtggctttcgccgtggcaagcggacacggaggagtgggattcagcggtgctgtggccctggccatcgggatcgggattcagaatttcccggaaggggcggcaatttctcttccgctaaggagagaaggtttttctaaaggaaaggcatttttgttcggggcactgtccggtgcggtggaatttgtgttcggtgtgctggccgtgctggcagcggaaggacttggaacttatatgccgtggcttttgtcttttgccgcgggagctatgatctatgtggtagtggaagaactgatccccgaggcacaccttggggaacactcccacacgggaaccctgggcgtcatggttggattcctgatcatgatggtactggatgtggctttgggatagccagtgcatagctgctttacggatcgggctcagagaacgaaaacaggcgcgagatatttatctcacgcctgttttttcgttctctatatcgatatcaatggtatctttaaatacctgttctaccagacagcagtactctttgtattcgtgataatcagaaaactcttcaaaacactcgatcatgcttttgtaataccagccctgcatattcttatctttcatattaaagcgctgccacagctcgtctcccagaagcttgtagtctctggccagagaacggacgttggcaagcttgtccccaagggcaatgactttggcaggacgtttggcgcggtgttttaagaagtccacagtatgacgttttctctcaatccaggatctgctcttgtcctcactctccatcaggacataatccgctactttgtccccaaattccctccgtatatcctctccggtcacatctttgcagtcttcgatgacatcgtggaggaccgcggcgcacatcatctcttcatccggcgtaatgccggcaacgatcgaggtgacttccaggggatggatcataaatgggatatcggttccctttcgcttctggccggaatgggctttcgctgcaaagataattgctttctcaaacatgggtttctccttttttgcggacatttttacatacttatcataaatcatttttatgatgcggtcaatgaaggaattctctgctttgatgctttaaagtgacgatgtgttgacttttccccatcgccacggtaaaatgaaccatatcaatcaacacaaggagagcgatctatatgtcaacagagacgaattttacaataggatttatcgggcttggactcatcggagggtccattgccaaaaatgtacgccgtgtatttccgaactatacggtgatcggatatgacacagataaagaagccctgaaaaaggctgtggaggaaggagttctcgaccgcccggcggcggaacttaacagtgatttttccgaatgcagctatatttttctatgtgcgccggtgcagcataacctccagtttttagagcagctgaagccatatttgaaagagggatgcatcgtgacggatgtgggaagcgtaaaaggtgggattcataaaaaagtaaaagatctggacatggagacctgctttatcgggggacatcccatggttggttcagaaaaagccggattttcttacagctctgaccgtttgattgaaaatgcctattattttattacgccgacagaaaaagtaaataccgagaaggtaaaagaatttacatctttcatagaagaactgggtgcattgacgatcctgctggatgcaaagcgccacgacgcttttactgccgcgatcagccatgttccgcatattatggcggcagaactggtacatacggtgagaaatatggacaccgaagacggcatcttaaaacagctggcagccggcgggtttaaagatatcacaaggattgcatcatcctctcctgttgtctgggagcagatcagtctttccaataaggaaaacataagagagcttttagtgcagatcaaagacagcatttccgaaatgatccatgcgctggacagagacgaccacagttatctgaacgagtattttagagaggcaggggagtaccgggagaccgttccggacagtgccgtgggactgatggaaaaatcttatgagatatttgtagatattccggatgagccgggaacattgtctacgactacgaccctgctggcgcttaataacatcagtattaaaaatatcggaatcatccataaccgggagtttgaggaaggtgtcttaaagattatgctctatgatgatgtctccgccaaacgcgccagagagatactgcaggataaaaattacagtgtatatgaaaggaactagaaatgaaacttaagaaagtagaaggactaaaaggcacgatatccataccgggagataaatccatcagccacagggcggtcatgttcggctctctggcaaagggaacgacacatatcacaaacttcttatccggtgcggactgcctggctaccatagactgttttcgggcaatgggagtcaggatagaacaggacggcacagaggttacggtacacggcaacggcctccacggacttaaaaaacctgagaaacagctggatgtgggaaacagcgggacgacgacccggctgatctccgggattctctgcggacaggattttgaagttacgctttcaggcgatgcatctttaaacaaacgccccatggggcgcatcatgataccgctctctgtgatgggagcagaaattgagagtgtcagcggaaatggatgtgctccgttaaggattaacggaaaaccgctgaaggcggtccactatgaatcaccggtggcatctgcccaggtgaaatccgcagttcttctcgccggactttatgcggacggcagaacgagtgtcacagagcctgccctgtccaggaaccatacggaactgatgcttaagtctttcggagttcaggtattgtcggagggtacaacggcatccgtgatgccgccaaaagagatgacggccacggacattgcagtgccgggggatatttcatctgcagcgtttttcattgccgcgggacttgtgactccggattcctgtattaccttgaaacaggtcggcattaacccgaccaggaacggcatcatcaaagtctgtgaagctatgggggcagatcttacgatgtccaatgtaaaagacgataacggagaaccgacggcagatattacagtaaaaacaagcaggctgaaaggcacggagatcggcggagagctgattcccacactgattgatgaaatccctgtcattgcattgatggcggcttttgcagaaggcgagaccgtcatcaaagatgcggcagaacttaaagtgaaagaatctaaccggattgatctgaccgtggataacctggtgaaaatgggagtcaatgccgaggccaccgatgacggaatgatcatccgcggcggaaatccactgaggggagtgtctatccactgcaaatatgaccaccggatcgccatgacattttctgtcgcagggatcaatgcacagggaacgacggtcattgaggatgcagagtgtgtggacgtgtcatatcccaacttttatgagcagttacatatgctcgccggacaataggattcttccattgacaagctggaaaattcttcatacaatggagacagcagtgacagaaaattgacagaatcaaatagtgggaagggaaggatcgcagagtatgaaagaatcaagagtgaagatcctgcgtctgacagcgtggctggttgccagtgccatgtttgtcagtttaagcagtgaggcagtggtgcgggctgcccagagaagaaacaggatcgcaaaagtacagccaaagaccgctgtgacagaaacagaacagaaggcaaagacaacaaaagcatcagaagaatataaggctttttggttctcgttttatgattacgatgaatatcgtgacacctataaaaagaataacgcatcaaatttcaaaaagtattttacaaaagttgtaaacaagggaaagagccttggcatgaaccgtgtgatcgttcaggtaaggccgttcggtgatgccatctacaagtccaagtacttcccatggtccaaatatatttcaggaaaacagggcagaagcccgggatatgatccgttgaagattatggtatccgtggcacattccaaaggaatggctattgaggcatgggtgaatccttacagggtgaccaagggcagcaccagctataaaaagctgtcaaagaacaacccggccagaaagtggaatgcaaaaaaatctacaaggaggaatgtactttcctacggaggaagcctttattacaacccatccaaaaagggcgttcagaacctgatcgtgaacggggcaaaggagatcgtccagaagtatgatgtggacggtatccatatggatgactacttctatccgagttttacaaagaagaatgtcaagaaagcattcgatgcaaaagaatacaacaagtcttcctacaaaaagaagaaaaaaagcatttatacataccgaagggctcaggtaaataacctggtcaagaggatgaaaaagacgatcaaaagcgtggacccgaacgtgacctacggcatcagtccggctggaaacattgacaatctgaccagcaagtattcttactatgtagatatttataagtggctgaactccacggcttatgtggattatatctgtcctcagatctactggggattcaaacatccgacggctgcatttgacaaagtgacgagacgatgggtgaaggctgcaaagaagaaaaaagtgaagctctatattgggatcggagtctaccgggcaggccacaatgcgggacagaaccgggcagagagaaaagaatggaagagtgacacgaaggtgctgaaaaaacaggtacagtatggccgcaagtacaaagtggacggattcgcattttttgattaccaggaccttaagagcaaggcaagcagaaaggcagtgaaccagctgaagacagtattaaagtaaagaaaaaattttcagagattattcagaattataaaattctgaataatctctttttttgtaatatagatcgatgctgtgcccggtcttcttcacaaagatcagcggtgctgttttttctgccttctggaaataacagaatcaatcagaccatattttagtgcttcttcagcactcataaaatgatccctgtcagtatctctttcaatttcttcgatactgcgtcctgtattttcagctaatattctgtttaatctttgtttgtttttttgcatataatcagacattatttttatatcgcttgcttgtccttgaataccattaccatgtatagccggctgatgtatcataatttcagcattgggtaacgccatgcgcttgccctgtgtgcctccggctaacaaaaaagctccaaaacttgcagctaaaccaacgcatattgtggcaacatcacatttaatgtatttcatggtgtcatagattgcaaagccggcagttacggaacctcccggactgttaatatagaattgaatatctctgcctgggtcctgggcttccagaaagagcatttgtgctacaattaaactggcagaagtatcacttacttcttcacctagaaaaataattctgtctgacagcaaacgtgagaaaatatcatagcttcgttctccccggttcgtttgctcaatgacataaggaattgtactcatgcagccagctccttctctttaatcctactgataaatctaatattttgtgcaaaatagaaatttccacacaagaatattctattttgctttggcacaaaaacccttttatttctataaattttgggcggatatacatataactgcttaaatgcaagtgaaaatgcctgctgagagtcatatccggcttcataagcaatttctgtaataggctcgtttgtttttatcagtttttccgcagcaatggtaagcctgcggctttgcaggtatttataaatggtaattccggtacgttcagaaaatatgcgattcagataaaattttgagtaaccaacatttttagcaattatatctacactaatttctcttttgatattatcctcaatgtaattcacgactttttctacaacctctttttgctgtttcatagtttcacctccttctatcattataattagtatgagtttccgtgtcttaataaaaaatgctgttttactgcccactttactttttcatgatatgtcacaagtctgcaacaatcatctctttcgcactgttttgaatacttttggcatcctcagccaaaatatcggaatctgtgatcagcaggtcaacgtcacggaccggatttccctgaaatgctttgtgaagtcccttgtccggttatcaacgtaacatcatttataacagggacacggaaagataaaacagtgcttagaatgctggaaaactaaaaaatggactgccgtatgattggaagacaacatctaaaaggggcatatcacataaaataacctgtgtgatatgctcctttttcacggacaaaaaagtatttgcattgacatattataagaaagagtatattatatatcatatagtattaataaaagtataatatgggagcgtgtctatggtatttaatacaggagctgctttgctggacgccattgtcctggcagtagtctcaaaagaagaagaaggatcctatgggtataagattacccaggatgtaagaaaagtcctggatgtatcagagtctactttgtatcccgtgttgcgcagactcagaaaagaaggctgcatggaggtttacgacaggcagtgcgacgggagaaaccgaaggtactataaagtgaccagtcagggtatgattcaactgaacttatataggacagagtggaaatcttactcatttaaaattacgaaaatatttgaaggaggggcagtccatgagtaaaaaagaatttctggaccaactggcatatttgcttcaggacattgcgccggaagaacgggatgatgcaattggatattatgtggattattttgaggaggcgggaccggaacgtgagcagcaggtgatcgaggaattggggagccctgaaaaaattgccgccatgatccgggactcactgaacgggacgaccggagaagaagaatatacagaaaacggatatcacaaccagagatatgatgagaacacgaaaatgcctgagaaggcaaagaaagaatcaggatttcatttcaaagggaaccgggaccggaatctgatccttatcgttttgatcgttgtgggcacagtggtactcggtcttcccctgatcggtgtgattggaggaactgcggtcgggatcgtcggtatatttttcggcttcatatccggggttgccggaatcagtgtggggcttctggcaggagggttcggtgtattcgctgccggaatcgtaaagatgttcacgaagcttcccacaggatttatgatgtgcggcggcggtttgatcatgatggcagtgggcctcttgttctgtgtactttttgtctggatactcgtaaaagtatttcctcctttgatcagaggagtcgtagatctgatccggaggctgtttcataaagggggagaagaagcatgaaaaaattttataagatctgcctgatcatctgtctggtatttactgttgcaggagctggctgcattatcgcagcggcggctatgggtttttccttcacggatacttatgactatgtcagagacaaaataaacgggtacacaggcagatatgaaaatgatgaggcagagcggctggaatttccgaaagccaaagtaaagaagataaaaatagcggttggaagcagggatttgtccatcgtcagaggagaggggagtcaaattgtgttcacaacaaaaggaagccgaaaattgtttcaatcccggcttgatgaaggtctcaatgaactgaccatccggtcaaaatcttcggttcaccgtccctttttctttgattatggatatgaacaggcagttttgagcataccaaaagatatgaatctggatgttttcagtgtggatgtaggaagcggagatttttcatcagaggagttgtcttccaaaaacatgaagatccagtgcggaagcggagacatcaaattgtctggtctcaggtctgataatattgatatccagtgtggaagcggggatgtggacgcagatatatgggacggcagagagaactacaaatataatattagtgtgggaagcggagatgtggtctttgacggacacgaactggaacacagcaataaagagggttcctggggaaatgggacgaaattcataggtgttgaatgtggaagcggagatatcgacatcaactttttgaacaatgtataaggaggagattttcatgagcagtaaacgattatataaatcaagagaggacaaaatggtctgcggcgtatgcggaggaatcgcagaatatttcgatgtggacccgaccttggtacgattgggcgccgtactgttgggctgttcaggaaccggaatattggtttacatcgtggcggcagtcatcatacccgagagaaggtattaaaaatagtaattgcatctgttgtcaaagctatgatataatattatccgaaaaagaccaagtcaaaaggcttggtcttatattttgacaaagaggagaaatcatatgaaaacaccaattttgatcgccatgattgcctacatggcaatggttgtgtacatcggagtgatttacagcaagaagaataagacttctgaagactattttctgggaggaagaggactcggtccctgggttacggcaatgagcgccgaggcttccgacatgagcagctggctgttgatggggcttccgggactggcttatgcatccggcttcagccaggcgggatggactgccatcggcctgattttaggaacctatttaaactggaagatcgttgcaaaacgtctccgccgctatacggaagtttccaacaactctatcacggttcccgactttttcagcaaccgtttcaaagatgagaagaagattttaatgtttgtctcatccatcatgatcctgatctgttttacggtatatacagcatccggatttgcggcctgcggaactctgtttaattcagtattcgggctcaattaccaggcaagcatgatcgcctgcgcggcagttatcgtcatctatacatcgatcggcggattccttgccgccagtactacagacctgatccaggggcttttaatgtcctttgcgatcgtcacagtcctgatcgtgggagttgcggctgtgggaggcgtcggaaatgttgtggaacacggcaaggctatggaaggattctttgatgtcatgaaatatcatgatccggccaccggacatgccgtatcccagggtgtaattcccatcctttcaggacttgcatggggacttggatacttcggcgtaccgcatatcctggtacgttttatggccatcaagaatgtaaatgagatcaagaaatccagaaggattgctatggtatgggtgatgatctcactgactgtggctgtgtgcatcggatttaccggagcggctctttatccgaacgtagcggagcttgcaggcagcggaaaccagaggatttttatctatatgacgatgcacctgtttaaaggaattattcctttgctttttgcaggtattattttgtcaggaattctggcagcaaccatgagtacatcagattcccagctattgatcgcttcttcctgtgtcgcgaagaatatgtatcagggattctttaagagaaaagcttccgagaaaaaaattcttatcatttccagggctaccacagttgtcatcgcggccatcggagttatcattgcactggatgaaaacagctccgtatttaagctggtggaaaatgcatgggcaggatttggcggagcgtttggtccgttgatcttatttgcactgttctggaaacgcaccaatttaaaaggagcagttgcaggaatggtcagcggcggtgtcatcgcccttgtttggccgtatacgtttgcaaagcttggcgggatttttgaaatttactgcctgctgcctgcatttatcgtgtcttctctgatgatcatcgttgtcagccttttgacagaagaaccgaccaaagaaatgcaggaagaatttgaagaagcaagaaagcctctttaaagtttgaaaattatgcgttatgatatggatatggtaagttttacataaagaaaggggaaaaagcagtatgttaaatgaaaaagtagcacaattgatgaacgatcagatcaataaggagttttattcttcctatctgtatttagatatgtccaattactatgtggacaaaaatctggacggatttgccaactggtttaagattcaggcacaggaagaaagagatcatgccattttatttatggaatatcttcaggcaaacagctgcaaagtaacactggaggcagtcgcaaaaccggataagagctttgaagaaccgatggacccgctcaaagcagcattggagcatgagcagtatgttacttctctgatcaacaatatttatgatgcggcatatcagtgcaaggacttcaggagtatgcagttcctggactggtttgtgaaagaacagatggaagaggagaataataccgattccctcgttcaaaaatttgaaatgtttgggactgatccgaaaggcttatatatgctggacgcagagcttcagacaagagtctatgccgctccgtcactgactgttttataaatttcataaaattttccgggattgcctttttgttaggcaatcctttttttggcgttcatgactctgattccataatataaataaaagctgatctgcacattctatggatgttcacataaactgatattaacagaaatgaaaggagatatttcgttggaaaaatacaatcagcatagatgctcatgcggacagccggcaccatatgagatggaacgtacctgcgggtacaattcaaaaatgaagagaaatggtaattacggtcaccgccacgacggcgtggattccatggcactcgcaatggcatatgtgccgtggcagcattgggatcagatctattgccctgaagagggattggcatgcggtaccattttcccggaacttaacaaaccattttatgggaaagcggggtgcagacgatgaataaatatgatcaggaaaaattattgagatatattgatgcagtcagctttgccttgattgatacgacactgtacctggatacccatccggatgaccaggaggcaatcagtcactttaatcagtaccagtgtgccagaaataaggctgttaaagagtattcccaatactttgagccattaacaattgattctgcagagattactgacactttcacctgggcaaccacgaaatggccttggcagaaggagggatgttagcctatgtggaattatgaaaaacgtttggaatataaagtcaacatcagaaaatgtgatccgatgcttgcgaaagtgatcatcactcaatacggcggaccgaacggtgaactgggcgcttctatgcgctatctgtcacagagatttgcgatgccctataaagaagtatgcggcgtgcttacagatgtgggaacagaagaacttgcccatctggagatggtttgttccattgttcatcagcttacacgtgaccttacgcccgagcaaatacaggcagccgggtttgaccagtattatgtagatcacacaaccggtatctggccacaggcagccagcggagaaccatttaccgcagatttcttccagtctgtgggagacccaattacagacttgacagaagatttggctgctgagcagaaagcaagaacaacgtatgacaacctgctccgtctgattaaagatccggatgtcagagatccgattgctttcctcagagagagagaaattgtccacttccagcggtttggtgaagctctgaggagagttcaggatcatcttgattctaaaaacttctacgctttcaaccccgctttcgactgcaaaaccaaataattacgaagttttttctcgttttaatcggcaggacctttgttctgccgtttttctttttcgtgaatttttaagaaattctctatattataaatggtcttttcatttataaagtgttctattttttctacctgttccagttcatcttcgctttcattgatcatgcacaggaaccggttcaggatatcatgccggaataaaagataatccccggcttttctgcctttgtcggtgagccggatatatccgtatttttcagataacagatatcccaggtcctttaaattttttaccatctttgatgcagaggaaggcttgacatggagcatgtgggccagctggtttaccctgacgacttcttctgtcaggagcaggcggcagatcatttccagatagtcttccatagaggccgtcatattgtgggcctctccgttctgataccctttcagtgtataaaatccttcttttttttccatgagccgcttccttttcataaaaatattgtaacgccttattttgtccctcaatataatagcattgagaaataaagtttccctatcctaatggatattaaggagtgaatcgttttatgagtcagaattgcagtttaaatgaattaaatccgggtgaaatcgcggtggtaaaagaacttaagatcagggggagcatccgcaggaggcttctggacattggactggtgaaggacactaaggtagagtgcgtcgggaagagcccggcaggagacccggcggcctttttgatcaggggtgcggtgatcgcgatacggtctgaagatatgaaagatattgtagtaaggatttaaaacaggaggacataatgcgatgggactgaccagtcattccaccggaatgaaatccgtagattcggggctgaacgtaaaaaaacagaatccaaaggacaaaattgttgccatagcggggaatcccaatgtggggaaaagtacggtgttcaacaatttgacgggaatgagacagcacacagggaactggccgggaaagacagtggcaaatgcacaggggtactgcaaaacagagaagaattcctatgtcatgatcgatatacccggcacctactctctgatggcacattccgcggaagaggaagttgccagagattttatttgttttgaagaaccggatgcggtcatcgttgtatgtgatgcctgctgtctggagagaaacctaaacctggtactccagactatggagatcacagaccgggtcgtagtctgtatcaacctgatggatgaggcgggaaagaagggaatctcgatcgatgtccgggcgatctcagacaaattgggggttccggtggtggcagcggctgccagaagcggagagggccttgcggaactgatgaatgccgtcgatgccgttgccgacggcagatgggatcaaaagcctgtaaaaccattgtatgattcttgtttagaggaagcactgaaaaatctcaagccggtggtggaccaaaaggtatcgggcaggtttccgggccgctggtctgcacttatgcttctggagtcagatccttttctgcttctggagatagaacagcggctgggcaccgagctaagagaagatccggatatgaaacaggctgttaaaaaagcagaacagattctttcagaagacggaacagaggatctggaagacaggattgtctcagggctggtaaaaacagctcaggacatttgtgccgatacagtcctgttcgggacaaaagattatataaaaagggaccggaagctggatgatattctgaccagcaggaaaaccggatatccggtgatgatcggacttttggccatggtactgtgggttacgatcgttggagccaactatccttcagaactgctgtcaaaggttctgttttgggcggaagaccgccttgccgggctgtttcttaatgcgggactgcctgcatggctttgcagtatgctgttctcaggagtttaccgggttttagcctgggtcgtatccgtcatgctgccgcccatggcaatcttttttcctctttttacacttctggaggacgcaggatatcttccgagagtcgcatataatctggaccggtcctttaaaagatgctgtacatgcggaaaacaggcacttactatgtgtatgggctttggatgcaatgccgcagggatcgttgggtgccgtatcattgattcgcccagggaaaggctcatagcgatcctcacaaactcattcgtaccgtgcaatggcagatttccgacgctgatccttatgatcaccctgttttttgtagggacaggagacggactgcccgcctccatcggctcggcggtgctgctgacgctgttgattctgctgggggtatttatgacccttgcagtttcaagactgttgtcaaaaacggtgctcaaaggaatgccggcatcttttacgctggaacttccgccgtttcggaggcctcagatcgggaaagtcatcgtaagatctatttttgaccggactttatttgtcctgggccgtgcggcggcagtggctgcaccgacaggactgctgatctggattctggccaatatttcaataggggaaacaaccttgctttgcggatttacggagctgctggacccgttcgcgagaatgatcggactggacggagtgatcctggctgcgtttatcctcgggtttccagccaatgaaattgtcgtgccggtgatgatcatggcatatttgtctcaggggataattacagaacccggaagtgtggagacgatccgtcagcttctgatacataacggctggacacagacgacggccctgtgtatgatgctgttttctctgatgcactggccgtgttccacgacgctcctcaccattaaaaaggaaacaggaagtctcaagtggacgtttgctgcttttctgctccccaccgcagccggctgtctgtgctgctttttcgtaaagaatatgactcagcttgttcattatattttatgataaatataaccaggccttaaaatagcttttctgagctggatttaatctgatcatgacagaagtctggggatttgcgggatgggttgtatggtgtctgggttctatgattcgcatagcagctgcaccatacagcttttttccgattttttgattacttgattgccggagcttttgttttggtttatggaggaggaagacttgatgttggttgtgaatccacacatcgaaatgctttctgtcaatggggtcaagccctctaaagagaccattcgaaatggtacttatcctttgaatgtctatacttatgcagtgacactgaaaagcaataagaaatagaaactaacaaatatttggttttcatggcatttctttgttgcttctctggtgaattcttgttacgatactgttatcttagcgaaaaagaaagaagtatgggaaagatgaggggaatatgaacatcattatcgtaggctgcggaaaagtcggccgttctttggtagaacagttaagcagcgagaatcatgatatatccattgtagatccaaaggcatacgtcgttcagtcaatggtagatatgtatgatgtatttggaattgtgggaaacggggcaagctataatgttttaacggaagtcggagtggaagaggccgatcttttgattgcggtgacgaattcggatgaattaaacctgctgtgctgcctgatcgctaaaaaagccggaaaatgtgccaccatcgcaagagtcagcaatccggtttattttgatgagatcaattttatcaaagaagagatggggatttccatgatcattaatccggagctcgcagccgcttccgagatgtccagaattttaaggattcccacggctatggagatcaactcctttgcaaaagggaaagtagaactgttaaaatttgttctgagaaagagttccatcctaaatggaatgaagatgaaagaaataggcgagagaatgcgcggtgaggttctcgtctgtgcagtggaacggcagaaggatgttttcattccttccggggattttgttttacaggaaaacgacaggatttcgattgtggcttccccgaggagtgccagcaagttttttcagaaaatcggtgtccagatgaaccctgtcaggaacgtcatgatcgtaggaggcagcaaaacagcgtattatctttctaaaaagctgctcagaatagggatatcggtaaagatcatagacaaggactttgatcggtgtgaggaactgagcgtactgcttcccaaagcggtcattatccacggaaacggaagtgaccaggaagtcctgctggaagaggggctcctggagacagatgcctttgtggcactgacaaattttgacgaggagaacgtgtttttatctctctttgtaaaagggcagacacccgcaaagctgatcacaaaggtgaaacgtgtcagctataatcatattatcgacggtcttgacctgggaagtcttatatatccggaatatatcacggctcagtatatcgttcagtatgtcagggcaaaacagaattctatcgggagcaatatagagaatctgtataagattgtggacggaaaggcagaggccctggagtttcatattgaagaacatgcaccggtcatcggtattccgctccagatactgccgctgagggaccagatcctgatctgcagtattaaccggaacggaacggtgaagattccaacaggacaggatatgatacaggtgggagacaccgtgatcgttgtgaccacgaagacaggcctgcacgacatcagtgatatactgaaaaaagaatagagatgattggagaaaaaagaaaatgaattacgctgttatccgatacatattaggattggtcatcctgtttgagggtgcctttctgtcactgccgtgcattgtagccatgatttacagggaagccagaggcatccctttctttgcagttatgctcctctgtttctttgtcggatttttactgagccataagaaacccaaaaatatgcagtactatgccaaagagggatttgcggccgttgcattgagctggattctgctgagttttttcgggtgtcttccttttgtatttaacggagacatcccatcctttacaaatgcaatgtttgagatgatttcaggatttaccaccacgggagccagtattttgtccgatgtcgaagtgctggcaaagtgcagtctgttttggagaagcttcagccactggatcgggggtatgggtgttcttgtatttatcctggcaatccttccgatgggaggaggacaaaatctgcacctgatgaaagcggagagtccgggcccgtccgtaggaaagctggtgccgaaggtaaggcagaccgccaagatcctctatggaatctactgttttatgacgctgatagagatcgttttgctcatgtttggaggacttcctctgtttgattccatgctgctttctttcggaagtgccggtaccggaggcttttctattcttaactccggattggccgactattctccctatattcaatatacggtgacagtctttatgattttgttcggtgtaaatttcaatgtatattattttattctgatccgaaagtttaaagacgcatggaagtttgaagaactgaaatactatctgtttgtcattgcggctgctgtcatatgtattacctacaatatcagggacctgtttccaaccctggaatcttcattccgccatgccttctttcaggtaggctccattattacgactaccggttattcctccgtagattttaatgtctggccggaattttccaaggtgattctggtaatgctgatgtttatcggagcctgtgccggaagcaccgggggagggattaaagtgtccagagtgattctgatgctgaagacggtaaaaaaagagatgtatttttacatacaccccagaagtatccggaaaataaaatttaatcagcatgtagtcgagcatgaggtaatacgttccatcaatatttttctgatcacctatatgatgattctggcattttctacactgctgatcgctttggatggatttgacctgatcacagattttactgcggtcgtggcgactctgaacaatatcggaccggggcttgagctggtgggaccaaccagcaattttggtatgttttctgatttttccaaagtggtcctgatgtttgatatgctggcaggaagacttgagctgttcccgatgctggtcctcataagtccgattacatggagagataccaaggtgtttaagaagattccgaagtacaggaaggatagtcctggagtatagaaagtgtaatcagaacctgggatggcaggtaaaagaaccacattccgttttgtgcaaaggataaaaccgattccggtacagaaaagggagctgcgggggaaagattgaaaagtcctacgcagatatcacagcagagaaataaaatgagtcctgcactaaacaatctgtgttgaagatttatacggcgtacggcaaggctttctgccgcattgaagagtaactgggtgaagtagaagactccggccgccgtgagaagattccatgtatggagaattcctaaaaacacaaacatacatcctgtgagaagaaaacgaacgggcagaaacggaagaaaggcaaagcctccggcccggaggagacggcagtaatacagcatctggactccgcagaaacacaggacaccggccggataatttgtgtcaaggaccaggagaaatacatcggcagcggcggtcagtccgagggcggatattaccagtatgcggtccttagttttgccatacattaaaccgaagaagaagcacagcaggatggagcagtatttcagaatggtgcttaaaaggcctgaggaagatgtgagatccagcactaagaaggaaacataaagaatacattctgttaaaacgaaaagaagtacagcggaccctgcggggtctgtttttttcattttgcaccttcctttctgaaaacgccatggattttttgcctgttttatagtattcttattaaaatgagaatttatacaaggaggttgattatgagtcgagtatttaagttccacaatgatgtggatacggaccagattatagcatcccagtatttactgctgccgaatattgaggaaatgaaagtatatgcctttgaatctatcgatccggatttttcaaagaaggtgcaggaaggcgacatcgttgttgccggggagaattttggatgcggctcctccagagagcaggcgccgagtgtgttaaaggccctgggggtaaaagccatcgttgccaaatcctttgccaggatattttaccgcaacgccatcaatatcggacttccggtcgttgtaagcggggaactctatgacaaagtagagcagcttgacgagatcgaactggatctgtctgaaggcgtgatcaagacgaaagatgagacgttgccctgcacaaaactgccgccttatatgcagaatattttggatcacggcggattaattaattttctgaatgaaggcgaggtgtagattatgggaatgacaatcggagaaaagattatcgcgagggcggcaaaggtgccggaagtgaaagcgggagaaatccatacagtggagcttgaccgcctgatgagcaatgacgggacgacacatttgacgatcgatatgtatcacaatgatttaaaacatccaaagattgcagataaagacaaactggtcttcattattgaccacaatattccggcggagaatccaaaaactgcggaggcccacaggaaaatgaggaacttcgccagggaacatgacatcgccttttatgaaggaaagggagtctgccaccagatcatggtggaggattatgtatgtccgggagagctgatcatgggagccgattcccatacttgtacatacggtgcgcttggcgccttcggaacagggatcggatgtacggactttttatacggcatggtcacagggacctcctgggtcatggtacctgagacgatccgctttgagctgaccggaaaattaagagaaggcgtatatgccagagatctgatcctttcaatcatcggcatggtaggagccaatggatgtaactataagatcatggaatttgcaggagaaggggcacacaacttaagtattaatgagcgtctggtattgtgtaaccttgcggtggaggcaggagctaaaaccggaatcgtggagcctgacgaaaaggttgtggaatatgtggaatccaggggccgtaaggcagaaaacctgtttgtgagcgatgaggacgcccgttttgaaaaagtttaccatatcaacctggatgagatagagccggtggttgcgaggccgcatttgatcgatgatgtcgtgccggttgaagaagccggagacgttaaaattgacgaggcatttttaggttcctgcaacaacggacggattgatgagctgcgtctggcggctgagatactgaaaggaaagaaggttcatgaggacgtcagattcctgatcgcacctgcttccaatgaagtttatatgcaggcgttggacgagggactgatcgacatcttcatggaagccggagccatggtcatgaacagcaactgcagtgtgtgctggggaagctgtcagggtgtgatcggtgaaggggaagttttgatctccaccggtactagaaatttcaaaggacgtgcgggacatccggattcttatgtctatctgggatctgcggcgaccgtcacagcgtctgccatcgcagggaaaatcgtgaaaagataaaggagtttacatatggaaaagtttactggaaaagtatgggtgctgggcgatgatatcgatacggatatcatcattcctacagagtatctggcgcttccgaccgtggaagacatgaagcagtatggattttctccgctgcgtccggagctggcatctcagataaaggaaggcgatatcatcgtggccggaaaaaactttggctgcggctcctccagagagcaggctcctgagatcattaaggcactgaacgtcaaatgtgtcattgccaaatccttcgcgcggattttcttccgcaactccatcaataacgggcttttgctcatcgaaaatgaccagattcaggagaaggtgaaggaaggggatactcttgatgtaacgctgggcgagtctgttgtgtatgacggcagggagtatccgatccagccgctgcctcagaatctgatggacattatagaagccggaggactggtggaagcaatgaaaaaaagaaatggggtgaaatagcatgggaaatacaattatcgaaaagattattaaaagaaatacaggggccccgacagtctccccgggacagatcgtgacagtcaatgtggaccgcgtgatgatccatgatatttttatcccgtttgttgcagaaaagtttgaggagatgggatttacaaagctgtgggattcggacagggtggttttgatttatgatcatctggttccggccagtgcggtggaagatatccggcattttaagattggtgatgcgtttgtaaagaaatacggactgaaaaacattcacagaaacgatgggatctgccatcagctcatgacagagtgcgggtatgccaaaccaggagacattgtattcggaactgactctcatacgaccacttacggatgcgttggctgcttttcgtcaggcatcgggtacacggagatggcttcgatcttagggaccggagagatgtgggtcagagtaccggaaacgatcaaggttgtcatcgacggcaaacttccggacaatgtatcttcgaaagatattatcctcagactgatcggagacctcggggccgacggggctacttacaaggctctggagttttccgggagcacagtggaagagatgagtgtggcttccaggatgacaatttccaatatggccatcgaggctggggcaaaggcggctttgtttgcgccggatgagaagacagcagagtattctgaagtagagttttccgatgtggattggatttacggagatgaggatgccgagtattgcaggacggttgtctataaggcagaggagctggttccagtggtcgcatgtccgtctcaggtggataagatcaaaccagtatctgaggttggaggtacagaacttgaccaggtattcatcggttcctgtaccaacggaagattggaagatttgaaagcagcggcagaaatcctcgatgggaaaaaggttgctgattttgtgaagctgatcgtgacccctgccagcaggaaaatttatatggaggcatctaaagccggctatctgaaaattcttgctgaggcaggagccattatcacccagccgggatgcgggctttgctgtggaagagctgggggaatcctcaccgacggggagaagattctagccaccaataacagaaattttcttggaagaatgggaacatcgaaggttgagatttatctcgggtcaccgaagacggctgcggcatctgctgtggctgggaagattgtggcggctgagtagaaagctcatttgatattaaaataaaagttaaaacttgttcgaaatacgttatgaaagaagtatttcgagcaagttttttattgtttaaaaacaaattataaaaatagttattgacaaataattctacatagtataatataactatatagatagtgaataacaaaaatttgataaggaggaagatatgaggaaaatcaactgtttatttttaagtttggtaatgatttttacaattcaagggcatgtttatgcatcgcccaatgctagtacgacaaacgaaaatgacaaaacattggcagtaataacaaatctagaatcaggagagaaaactgtagttattccaaaaagaatttgttcaacaactttacaacagaaatcaaaacaaggggagatagaaaagagttatgaggtggtaattgagatacctaacacagaggctactactttagcaagtgatagtattagtaaaactgcaaccaaaaaagaggttaaagttacaggaaaatttaactatacaacccaatatccagataaagtaaaggtgtctagctgttcaggatcatggaaacccaaactgcagggagtatatgtaacaaatcgtgaagtagttcttcatggcggagatggacaacatatgaaaaaaagacctagtaaaaattcttttagttataatactaaatggggatataagccttatgtacctcaatccagtttatcaggaacaggcatgattatgaacgcagtaggcagagttggtggaatgaattcaaaagctcagattgaattaaaaattagtgggagcgatattttagacaatctaaagtaatccataagaggagaacaaattttgaacaaaaaactaaataaaatttcagctatattatgtggtttgtttcttccggtgctgctaactttggctattcctttccttaagatattgtttttgagccaacattattataccggatatctggatggagatgctatatattatctcgtaaaagattttgtgaccaatggaatatgggcaattggagtgcttatttatattttgtgggttatcagggataaaacgaagctaaccattatttcaaatatttttatcataatctgtgcattgtgtggatgctatattgtattgatcagaagtagcttgctgtattttgcaaaatacatagacactagtacttatacattagaatcaattttaattataatagcatgtagtttactgatccgtaagatttacttgtatttaagacattcatagagagattcaacaatgatattataactcctgcaaagacagaaggaatacaaaatcctgtctttacaggagcttttttgtataaaaagatcaatagataagcaacccaacaattcccgtaaacacaattacaaatacaggaggctttttaaactttctcagtagaagtacagcggtcccgaataaaatggccgcaggaagctgaaaagatgaaaggacgacatgctcatccgtaccaaacagggtaagcagcaagatggaaaaagcagcggaaagtacaagccctgaggaagatgccttcagaccgtccagtacagcggacatataggatgaatcacttttcttctggaaaaaccggtatagaaggatggagatggtaaatcctgagatcacacatcctacggttgccaccactgcgccggggattccggctacgcggatacccacgaaggaggaagtgttgactgcaataggaccgggcgtcatctgtgagatcgtaatgatatcggtaaaatcctgactggtaagccaatgctttgccagtacgacctgttctttgatcatcgggaggatcgcatagcctccgccgatgctgaacaggccgattttaaagaatgtactgaacaaacggaccagatttaagagcatgtctgacacctcctttttttatggagccatactttaaacaggcaaagcacagaacataagattaaaatcagcatggcattgatgtggaagacgaggttggataaaaaagcagcaggaaccatgagggtaagaaaaagagacttctttttcagaattatgcggcacatatctgtgatatagtcaacgatcagtgccgccgctcctgcctgcatgccaaggagaacggcggatacgatgtgactgctcctgaaagcctgatatcctgcggaaattatggaaagcaggatcagcggcggcaggatggccgcgatacagcttatgactgctccttttaatctggctatcctgtatcctgtgagagccgaaagattaatcgcgatggctccaggagaagactgggcaattgctgcgatatcaaaaagctccttctcggataaaacatgacggtttgtcacaaaatgtttttttaacatgggaacgaccacatagccgccgccaaaagtaaaagcactgacaatcaaattgacacggaacagccaggcatattgttttagtatatctttattcataacggatttcccctttttttaacagtatacgttttttcgaaacataaagaaaattatattattttatatataacatgttaaaatagtaatgataggagggaaagccatgacgataaggcgtttatatatttttaaaacagtatgcgaggaaggaagtgtcaccggggctgcgaagaagctctatatgacccagccggcagtatcacatgtgatccatgaactggaagaagaacttggcactgtgctgtttgaccgtatatcaaagaaagtatttttaaaccagacgggcaaattattattaaaaaagacagtccgcatcctggagctttatgaggatctggaaaaaggagtgtatgacttggagaaccaggctgtactccgtgtaggggccagcataaccatatcaagcttctggctgcccggggctatgaaacgatttcaggatacatatcccggaacgccggtcagtgttcaggtatgcaaggcttcggatgtcctttccatgctccacaataatgagatcgatctggcgctgatcgagggcgctgtctcagacagtacgctggacagcacggtcttttcttcgtttcgtctgtttgctttttgttctccggaccatccatgggcaaacgttaaggacattgaacttgaaagacttctggaacagccgcttctgcttcgtgaaaagggaagtgcgaccagggacgtgctggatagcgtacttcttttacatgatctgagggccgatcctttttggaccagtgtaaactctcaggtattgattcgtgcggcagaggaagggctcggaatcaccgtgctgccggaacgccttgcggcagaggaagtctcaaaaggaaaattaaagaaaatagaaatcaggggcatagaactcaagaatgagaatcatatcgttgtccataaggataaataccggacagggcctatgaaagaattcatcaatattttgcttgagggaaatgaaaatataagtgatttgtgatacaatggaaaatatttgacacaaggggatgaaaaattatgacagaattattgatatcggcatttattaagaataaggatgatttaaaaaaccataaagtccgtcaggcctatggcacaatgggaggagcagtgggtatattctgcaatatatttctctttgcagggaaactgactgcggggattctcacaggggccatttccatcaccgcagatgccttcaataacctttctgacgcggcatcttccatcatcacactggttggtttccacatggcagggcgtccggcggacaagaatcacccgttcggacatggaagaatcgaatatatttcaggactcctggtttctttggctatactgttaatgggatttgaattattaaaatcttctgttaataaaatcttcagcccggaagacattatgttccgtccggtgtccatagggattcttattgtatccattctggtgaaattctggatgtcagctttcaataaaaaggtcggaaatctgatcgactcagaggccatgaaggccacagccacagacagcttaagcgactgtatcgctacaacggcagttctgggcgggatgctgattttcaggtttgccgggatcaacgtggacggatatgtaggtattttagtggccggatttgttatgtgggccggattcggagcggcaaaggatactctctcgcctctgcttggaaccgctcccgatgtggaactggtggagaacatacaaaatgaggttttaaataatgagctgatcgtaggggtgcatgatatcatcgtacatgactacggcccgggccggcggatgatctctcttcacgccgaggtgccgtacaatgttgatattttggaggcacatgacgtgattgacaacattgaatatcatctgatgcataagtttaattgtgacgccaccattcatatggatccggttgtcacggatgatgaggagacaaacgaggcaagaatgatggtggaaaagatcgtaaaagaatgcggaaccgaactgtctatccatgatttcagaatggtagagggaaaaacgcacaacaacttgatctttgacctggtggtgccctatgaatgtgaccaggaagtgggggatattacgacttatatcagaaaggagatcagaaggcaccgggaaaattactttgcagtgatcaaagtggaccggagttatatctgaacaatgaaagatgaaggaacagctgaccaatgacatgagtgtaggaaatcccgcaaagaagttatttttctttgcggttcccattgtgctgggcaatttatttcagcagctttataatattattgattctatggtagtgggaagattcgtcggtgcacaggcacttgccgccgtcggagcatcgacggccattgtttttttatttgtagcagttgcgaccggttccagcatcggttattctgttgtcatttctcagctgttcggggcaaaggatcaggaccggatgatgacggcgatctatacggccttaatttccacatttgtgttgggactgattttaatgattatcggtgtggccggtacaggaggaatcctcgtattgatgaggacaccggcggatatttaccgggatgccgccaattatctgagaatctatatgttcggccttgtgtttttatttatgtataatactttaaatgcggtttataatgcacttggcgcgtcaaaaattcctctttattttctggcaggctcttcaattttgaatattgtgctggatttgtattttgtgatccggcttcagatgggagtgaccggggttgcatgggcaactctgatcgcacaggggctggcggcagtcatttcgtttatcaatctgctgttccgtcttaagaagatagagacagaaaaaaagccggttttatttgaccgaaagatccttgtccagatgggacggattgcagtaccgtctatggtgcagcagtctatcgtctcgttcggcatggtgtttgtacaaagtcttgtcaacagtttcggatctgtggtgcttgcaggatatacggcggctacgaagattgactcgattgcgatcatgccgatggtaaatgtggggaatgcagtgtctacgtttacggcgcagaatatcggggcgaaaaaaccggaacggatcagagaagggctgagagcgggaaggctcatggcagcaggcatcgcggctgtcattacgggaattctgttttttaagggggatgtgctggttgcccagtttgtggatgagacgtccaatgccggagtcattgccataggtgtggattatttaagggtcgtatctgtgttttatgcactgatgggacttatgaatgtggtaaatgcggttctccgtggatcaggagatgtgggtgtatttatggcgggcaccctctgcaatttcggatgcagggtaatatttgcttatatcctggctcattttctgggagcgtccggaatctggtggtctatcccgatcggatgggctgcggcatttacgatcggaaccttgagatatcgaagcggcaagtggaaggaaaaaggaattgtggagcgggagaaagattgtaaagagacgggggaaagtatataatgatgacaaagataaagatttaccgggaaaattatgagcatttgcccaagcgttttgttgataaaattgaatcggatcttgactatttgataaaagctgatattcccggtttaaaaggagtgtacttattcggcagctgtgcgcggggaaatatccgaaatggcagtgatatagacctgcttatatttacagaacaaaaattggaagacagggcattggcggcggatatcagatggaccttagatgatgagatatccggtatatccacggatgtagtctataccaacgaggagtccataaaggaaaatactatttttaagagaatattgaacagagataaaaagttaatactggaggtgatgaaatgattaaaaataactacctggacattgcaaaaaatgacttggagtatcttgaatctatcctcgctgtggggagtactttctataatcagcttgcagtacagtgtcagcaggtaacagagaaatttctgaaaggctacctggaattgtgctttttagatgaagatgtttcggacttattaagaaagcataatatgaaaaagattgcagtcagaatgaatcagtggaagccggatttaaagctggatacagtgggtctggcctatttgacagatttttattatgatgccagatatcccggcgacgatttttatacagtgacgaaagaagaatttgataaatgtaagaaaattatgtacgatactatttcaaaactgaaagagattccaattaaaaatttttaaatggcgtgaggtgaattatatgccgattgtgttaaaagcttatcaagagatttcaaacaaacaggcgatcgcaaatgccatttctaatgcggtctctcatctgttgtctgatccttccggcgagcggctggccaatgattatgttctgacactgacggagggggaacttctgattgaacagatcggatatttaaagggaagttcagacccggagataaaagaaatgaagagactcaaacgaagccagatccgcaggctggaattggaggaattttcgaataaggaataagatgaaagaatcaaaaaggagcagatatacgcatatctgctcctttttctaatattatattaccataaaatgacgaatttttcaagacttgtgatcctaaagcggcggcagtagaggaactaagagtcattgaagcgtgcagcgagaagacagatgggagatttgggctgagtctgtcaaaagaacaggcgagagaattgatcgcggggaggaatgaaagtctaaaaaaagaaagcagttctgtcacctatgagacggcacagatgctgatggaggcagttatatattgtatcggcctgtgcgaagaatcttacggaggagcgctgcggtccaaaaggggccttcgtgcggaggaggcgtacagcattgggtatgaaaaggtaatagaaaaaacatatgaggcaaaggctgtctatgatcgtctggccatggattttgaagattatggatgcgtcaattacagggatacaatagtcagcggcatgccgcagttttttctgcgctatgatgccagattctgtcctcaggatcatatcctgacactggattatccaacgatgaacaggtatgggaagaaaagcgggataaggcttatttatgaatatttatgtggcgcagagtgagaacagagacttttaagatgtttcgacagccgcatcatcacagctctcctaaggcatgtggaaagaaagcaggacgttgattatatggaaaatatatgttctctggtcctgctccaatctctcggatgtctgatttcaaaaaaacagcttacggatttaaccttgacgggaacagatacagaagaggtacggaaatatttttcaggtgacccggcagaaacgatagaggataaattacaggaaatgatcgggtttatcgtacaaagggccggaatggagccttggaaacaatattttcaaagagaggggaaagaattcgctgttcggatttataatgccatcaaatatgacgcactggatgcattattttatgtttgattgtatttttcaggacactttttatgactgtctgcatatattagcaaaagaaagttgatttgaggaattttatggcaggcgtaattttggatgccgggcacggcggttatgacaatggtgcccagtttaatggaagaagggaaaaagacgatacattaagactgactctggcagtgggtcaggcgctgagagataagggagtcccggtacagtatacgagacagaccgatgtctatcagtctccgattgagaaggccagaatcggaaatgagagcggggccgattactttgtctctatacacagaaactcaagcccgcttcccaacacatacagcggagtggagactctggtttacaacgacagcggtattaaggccgagatggccaggaatgtaaaccgcagattaagcgaggttggatttaatgacctgggagtcaaggagcggccgggacttgcggttctcagacggacgaatatccctgcaatattgatcgaggctggcttcatcaatacggtaaaagataatgagcttttcgattcaagatttaacgacattgcaaatgccattgcagacgggattgttgacacgattggatcaggacaacaggagcttggcagcacctaccgggtgcagatcggactgtaccgcaatttctccaatgcgcagtacgcgctgaatgaagcgctggctcagggctttgacggagatatcgtgtatgaggagccatattatgccgtacagcttggagaattcagaacgctggatgaagcagtccaattggaaaatgagctgaagcagcgaggctatgataccctggtggtcaaaaaataaggaggctgtgatttgttttatgtgagatcaacggatggaataaagattgcagtctatgactacaatccctttggggaggagactgtcgttttaattcacggatggcctttatcccatctgatgtatgaataccagacggaacttttatgtaggcagggttaccgggtggtgacactggatctgagaggctttggaaattctgacgccccggccttcggctattcatatgatcaaatgtcccaggatatctatcaggtgatcagaagactgaaacttaagaattttactcttacaggtttttcaatgggcggcgcgattgtccttagatatatgagaaaatttaaagggtttggagttaaaaaactgattcttttggcagccgcagctccatcatggacaaaaagaagagactttccgtatggactgacaagagaatatgtcaatgaactgatcgaactggcggaaactgacaggcctcagctctgctttaatttcagtcatgagcagctgtttgcaggtcctcagtctgaaccggcagtgaattggtttgaacagatcgcactttccgcttctggacttggaacggtccgggctgcagtttccctgagagatgaagacggaagagaggacttgcaggccgtccatgtgccgacatggatcattcacgggaaaaaggatgtagtggtgtcgaatgatctggtgaggatacagcatgatgaaatctgcggttccaagctgattcagctggacgaaagcggacacggcattgtgtacgatcagctggagttatttaataagtactttttaaaagctgtcagagcataaatgaaaagcagcaaaagaagagaagaatcggaacggctgcgggaccacagtttaatcgggcggtctcgcagccgtttatgtatctgtgttcagagcgaaaacagatgggttgcaatattaaaatatatcaagatggagcaggtgtctaccagggtggtgatcaggggagccgccatgatggccgggtccagaccgatcttttttgccagcagaggcagagtctgaaatgcattctcatatttggtgataatggctccggtaatggtggcggacagcataaggaaaagcagccataagattctgtgtttggcgtggctgatgacagaggtgccgaaataggattcctcattgggctgcatagccgccatgatggacatatcttcttccacctcatcctgccagacttccatggcatcgtcgaaggttacaatgcctaccatgcagtgttcaaagtctactacagggattgccaggaggccgtatctatggaacagcttgctgacattttctttgtcctcgtgagtgttcacatagatcagattggtctccatgatatcctttatgagcacatggctttcgctgagcaaaaggcttttagctgtcacaatcccgatgagccgtttttgttcgatcgcatagcatgtataaatggtctcctgatcaatgcctacccgcttgatctttttcagcgcctgctccacagtcatttcttttttcaaatccacatactccaccgtcatgatgctcccggcactgtcttccggatagtttaagagacggttgatggtctggcgtgtttctttgtcagtcacatctaaaatctgctcaacaacgttggcaggcatttcttcaatgatatcgaccgtatcatccatatacatgtcgtcgaacagttctttgatctcggtccgggtaaaggcattgatcaaggtctcctgcatggaagaggacatttcggtaaatacttccgctgccttttctttttggattaaacgaaataaaattgtgtattctttttcggtgaaattttccagcaatgatgccagatcgacgttattcatagaattgagcataacttttaaaacaggatattcccgccgtaaaagcaaagctttgatatttttttctctcatgtttctttctccttttatatagaaatttgaagattaaaacatgaataaaaaacccttccctgtatttatgaaataatgtgaaggaggtttggatttttcattcatgctgtattgacttcggggcgaatccatactctcacatcctttcttttttacagtttacaggtttcaacgcttttatcagaatacctttaagcaaagaacatgtcaaggaaatcagaatgagacaatctttcattccatataaatagtacatagaagatgaacaggggatggacagagtgaataagaaaaatctgatcacgggttttatctgcattgttgttttagggctgtcattgctcggcgggggcaatgcagccctttctgtctggaatcaaaatgtgaggatcttaaatcctgcagagaataaggaacttccgatttactgtgtggatacaaaaaagaaggaaatcagcctcacctttgatacagcgtggggaaatgaggacatcaaccaggttctcaaaatcttaaaaaaagaaaatgtgaaagcaaccttctttttttccggcgactgggtacagcggtttcctgtggatgtaaagaagattgccaaagcaggccatgacattggcaaccatggggataaccacaaatatatgaccagattgtcttctgatgagcagaaaaaagagattctgggggctcacagcaaagtccaggccgtgacaggagagcagatggaacttttccggcctccctacggagactatgatgaaaatgtggtaaaaacggccagacagttaaactatgaagtcattcagtggtccgtagatacggaccatacaaattaaaacagcgagaatatgtggttgcagaatcattgaaattgaaaaaatcaatggttctttttttacgttgttttttgaataactaattcataaggggttgggccatcgaccctttcaaaacgggcttctctttcattgggcagctgcagctgcccatatatattatgaaagagaaaatcaataaccttatatcaaaggagaaaaatatgaaagagaaaattattgcaatcgtaaatcaaaaaggtggtgtcggaaaaaccacgacaaccattaatctaggtacagagttggccaaacatcataaaaatgttcttctggtagattttgatcctcaaggaagtttatccattggcttgggagtccgtgacgaggaaatcccaagtatgagtgagttaatgctggcggaaatgaatgatcaggaacttccagaaaaaaagaatattgtattggaattggactatgtagatttaattccagcaaatataacactttcagcagtagaaatatcattgatcaacacaacctgcagggagatgatcttaaaaaatatcctacaaaaatataaaaaaggatatgattatattttagtggattgcggcccatcactggggatgttaacagtgaatgcccttacggcggcggacagtgtcctcataccggcatcggcagagttcttgagtgccaaaggtctggaacagttattaggatcggtagcaaagacgaaaagaaaattaaatccagagttacagatagaaggaattctttttacaatggtacaagaacaaacgagactagccaaagaaatgattaatatggtacaaaaggcatatggaaagctaaacatttatgatgtcagaattcctcgaagtattgatgtgggtaccgcaatacggcaggggaaaacgattagagaatttaatcataaaaataaagctgctgaagcctatcagcagctggccaaggaggtgttaaaacatgaatgaagagcttaaaagtattgataatatttttggacttgatgatagcagtgaattttctcaggaaccggttaatataaacgagaaaagtaagaacgacatagttgaaattccaatacatcaattaattgattatcagaaaagtgatatcggaaagaaaagatatcaggatcaggagctgcaggatctggcagattcgattaaagaacatggagttcttcaaccgattttagtaagaccaatcgagtcagaagacctttttgagattctggcaggacataaccgaagagatggtgctgttttagcggatttagagactgttccatgtattgtaaaagattatgatgatacccaagctgaactaattttcattgagtccaatttagaaaagggattggatcattttacagagtctgagaaaattgacttgatttatcgccgacatgaagctttaaaatcccagggccggaggacagatcttgaagagaatccggaaaaaatttctgcagcaaaagaatttaatctgagtagatcaaccatcactcggtatttaaaactttacaaattaacatctaatctaaaaaaattgctggataataaattgttgccgattgtttcagggttggaggtttcaaagttctccgaggaactgcaggagcagcttttcttttatttagagaatcagaacaaaaaattagatacaaaaacagcacaaaatttatcttcttattatcaaaaaggaaaactgaatgcagatacaatgctaaaaatcttggaaggaacattaaaaccacggaaagtaaaatacagtggttacaaaatgaataaaaatgtatataaaaaatatttcagtccagaacagccgcaggcggaagtagaagaaattatcgtcaaagcattagagatgtattttcaagaaggacaagacagtgagtaatgaaatttaagtcattggaagaattgtttataattgctataatattgttattattatgtataaatccaaaggaggaaaacaaaaatgaaaagcacaggtattgtaagaaaacttgatgaattgggacgtatcacgctgccaatcgagttaagacgtaatctggatgtaaatgagagggaccctcttgagattttcgttgatgaagatacgattatattaaagaagtataatccagcggacatttttactggcgaaatggatgatctagttgagtacaaaggcaagaaagtgtcaaaaagttctatcattgcactggccaaacttgctgatcttacagtggaataaagagaaacaaaaccggatccgacttatgtcgggtcctttttagttgtccagggtgcttagaaatattagtgaattttatgatcacaaacaatcctacccccaaaacattaatatttctaagtagccttgatagttaaaaaaagaaaatgatatgaatagggggattcgatgtacaaaaagaaaaaatttactgacgacgagataaaaaaagcaaatgaggtaagtatactttctttagcaaaaaacttgggattaaatatagagaagaaaaagaatgcgtataaagtcccaggatacggtggcttatatatgaatgagcaaagaaatcagtggaattgttttgcggcacaactatctggagaacagattcacggaggtggccccattcaattagttcaatttattctcggatatgatttcgttcaggcaatgaaatatcttcttgattctgctcatatagcagttcatgagaaacatctaaagccaagtgtgaaaagaaaatttaaactaccacctgcagcacaagattatcgccatgtttacgcctatttgattaagacgaggggaattgatcacagaattgttgactattttgtaaaatcaaagaaattgtatgaaaatacgtatcacagttgtatttttgtcggttatgattcttatggtgtggccagacattgtacaatccgagggacagtatcaaataatccttttaaaggtgaggctcctggcagtgataaacgatttactttttgtatggagggaacaacagacactcttcatatttatgaggcaccgattgatttaatgagctatttgactttatgtattaagtgggatcagaagaatttatggatagatcaccatctggccttatgctgtttagcaaatgtctctatagagacgtatttaaaacgatttcctcaaatacataagttaatatttcatcttgataatgatgaatgggggaaagcagcgacagagagatatacaaaggaatatcaattacaggagtttgaaacctgggcagaacatccaaaaactcagtacaaagattttaatgaacaattggttattgaaaaaaacttaggatgaaagaaaaagaaaggaggaagtttatgaattttggggattgttattttacacaaagtcagtataacaaattaatattattcataagatatagaagaaatattgttattgcttatgtttgtaatatcctgtgtattaataattacattcatgaggaagaaaaaaacgcatgacctgattaaaacatataaatatttggcaattcctactgcttcagaatatgtttttgtttatgtagagaacagaatttttaaaagaggttctgttgtatctcctttgtttctaggaaaagagtatgtctatcatttagataaatttttactaactggattgttttatacaatgttgtttagttttatttttattacttttttttgtattttttactcaagatattaaaaaaagaaaaagagagaaaaatattaagatttaattatgaaagggcagaaaaatgaatatgataatcctttgtctggtaagcttacctctctgcttatcgggcgttttttttgttcagatatatgagtattgggagatgagacaatgcatgaaaaagaagtaaaattccccaaatccattcggttttcaaacagtgaatgtgaaatagttgagaaaaaggccagtcaggcgcatgaaaatttttcttcttatgtcaggcggatggcattggaaggtcaaattacagtggtagaagatctgaaagacgttcaatatcagttatataaaataggaaataacttaaatcagctcactaggctggctcatgagggacagatcttagccgcagacttagaagagacgaatcagctactgcaggatatatttgatcagttattgcagattaagggaggataacgatggcgattcttgagtttgctaccgataaggcgggaaagccgatcaaatacgatacaaaaggcaaaatggagaaagtattaaagtatattaataatctggaaaaaacattaccggaattaaggggagggacctatctattgaatccggatcgagcccatgaggaatttatgcttaccaagcaagcctggggaaaagaggatggaaggatgtgtatccatctgattcagtcattcaaacctggagaaatcacagcccaggaagcttttcaaatagctgaacaatttaaagaacatgagaaatttcaagggtttcaaatctcatttgcaacacatacggatcgggatcatattcatacacactttatcatcaatagcgtaaacttcgataccggatataagtggcaatgtacggatcaggatttagaagaactgaaaagttttaatgatcaactttgtcaagaacataatttatccgtcattgatcgatcccggattcacaggggaaaaagtgaaactgagaagcaagccgagcaaaagggaatctcatggaaaagggaaattcagctggccgtggaacaagcgttacgtgttgctgccagtcagtcagaatttatccaactcatgaatcgacagggatatagagtaaagtggaatccgaagtatgttacctttatcgcttcagaacataaagcgatcagaaactggcgttttgatcctccagaagcttatacaaaggagcgttttcaggaatgtttcaaagaaaatgccaggaggtttcaaagaaccccggaggaagtaaaagaggaagcatctgcttaccggagagaagctttctttgccgtccgggatgctgcagcggtagctacaagtcaggaggaatttataaaacttttagagcagcaacaatatcatgtccgatgggatgacactcatgaatatattacatttcaaaaaccaggtcatcaggcagttagaaacagaaatttttatccgaaggagtcttataccaaggaggctcttttagagaaatttgaaagaaataaagaaacattaaagaaaatcgaaaaaggtacctatgtatcagactcgatagaagaggtaaaacggagtgatatgttgtattatctactccgtttttttggttctccaaaacagggagattatcctcatcagacaagagaaaggggtgattccattgaatacttaaaagaaagacaaaaagagagagaaaaaggaaagggagtggactgggaaatttgaaaaagaaaattttattgttctttgctggatgcattggtataacggtacttttctttgtctgtggatatgcatcaatttttttagattcttttctaaaggacccgaagcatatcaaatatgtaacacggccagatgagattattagaattttacaacagaatccggttgtcttgcagtttacgtttagcttttttgtgttacttttacttggagggtttatcctgtttttttcggaaacgaatacttataaaagtgaacaaatgaaagtaacaaaaaacataaaaacaccggtgccagctggccagggccagtttggtactcaaaggtggctgacaaaagaggaaatagaagaggaatttcattctgagacgctatcgaagaaggaaattttaaactatgaagggggcgagccactgtatcctgatggaggattagtcgttggaaaaattgatatgaaaaacggggttgaaaaaatccttcatatcattgatgatcttcacgcgattatccttggagctacaagggcaggaaaaacaagaaatcatgtcctgcagacaatttgcgatttaatgcttgctggtgaaaacatccttgcaattgacatgaagcaggaactctatgactatacagccccaaaagcgaaagagttagggtaccttcctatttgtattgattttattcatccatatcaatcggaccgttacgattatttagggccaattgtaaaggccttaaaggaagatgatgtgtcaaaagcaatccatgaaacatggaatctggtgtcacagctcgttggagaacctccggaaaatggagaaaagttgtggaacagcggagaatcttccaccctggcagcctgtattatggcagtcgcctacgataacatggatcatccggaataccaaaatctgaccaatgtgttttactttatcacggaaatgtgtaccgaataccgaggggcaatgcctctcgttttttatattcaatcgcttccggaaacacatccatcaaggatcttattggcggcaacgaacatagcagcgtttaaaacaagggcttctttctatgtgtctgctgtcatgactctccggttgctaacgatgccaagtattaataacatgaccagcaaaagtgattttgacctggaagaactactaatgaatggacaaaaagtgatcatttatctttgcctgccggcgagagacaagacctactttccactggcagctttaaccttacgtcaaatatccgatcagatcgatgctgtggccgataagatgggaggccggctggaccgccggttcaatttcattgacgatgaaattgggaatatgccaaagatcacgaatcttccaaaccaactggcttttcttaccggaaaaggaatacgacataatctatttattcagtcttatgctcagctagattacgtttacggaaaagaagttgcacagattatcagagataactgcgatctgacgatttatcttcgcagtcctaatcaggatacaagaaaagaaatatccaatgatttaggagattatacggtatcaacatattctcttaataataatcagccagtaggatctttaaaaacatctggtaatcgaggggaaagcacaaatctaacgggaagaaaattactgtttccggaagaggtcaaacagataaaacggccgaattctttagtaatgtcggatacatatccggcaatcacttacgcacccgacctaagtaaatggacgttcaatgaatttttaggtttaggaagcaaaaggcataatcagaagctacgtttaaaaagccagaaagaacgaaagaaaatcgaacgtccacataatgagaggatggctctctggggcatttggacgtattggaaagaacaaattgatcttatgatcgagcaacaggaacaggcaaaagcagcaaaacaggctgcaaagaaataggaggaaataatgaaacaaaaattgaaactattggcggggacttgtgctacaagtcttcttatttttatcaattcaatccagattgcatgggctggaaaaatttccagttggaaaggctttaccggaacagaacaattgttaaaagacatgcggcccaaaattatcgccatcagtggtttattaggaacggttgcgattgcatattgcctggtaaggatgaagatggccgatgaaatggacgcaaaagtctggaaaaagagagctatcacagttttagtatgttgtatcggtgtggtgttagtaacatcaacgttgtcagccgtattatcatactacaaataaaggaggtccaatgcttgcaagtttcttaacagatggaattacgggatttttagaagatctagcaaaagatcttgtaaaacaaatcaatgaattattaattgacctcttagacattgtgttaaatgcagacaaatatatgggcactcattttcatttagagggtatttcttttgcaaaagtgaatagtactatcttaaaatttgcgcttgcccttatcattttaaaatttttacaaaaaggatttatgatttatattttgcagtcagatggagatccagatcacgatccgcttattttgttgacaggatttttccaggccattgccatagccgtctcttttatggggctgtatacgccagttatggaaattttcaagtcatttacaaaacaaatcatgaatgcaattacatcaaaaggagagattcaacagattaaacaagcaatcattgacaccttattgggaagaggactcacaacggttataatggttgtcatttttctaggaatggtgttagtactctatatcttttttataaaaaatggatttgagttaatggtattaaaatatagcttgtcgatcacctgtgttggactgatggacagtgatggaggaacgtttaaggttgcgattaaaaagtttttgcaaatgggattcacctgtacaattcaaattatattgctgcgtctttcaattaccctttgtctaacgctgcatcctttttgggcaatcgcttgtattgcaacagcacttggcacaccaaaattaatgcaggaatttttgattgccagaaatggcggaggcattagcagtaaactgtatactctcagtatgttccggaatttagcgaggtaagcgatggggacaattaatgaggcgatcaaatattttttgattttaattgaggtcggaggaggtcttagattggcaggcttactcatcgaatgcattgcagatccggacacaaaggatggaaacaaaaaacgaatccgaaatgttttgatctttatgatcatcgcagtcacaattattcctttaaaaaatatcatcgtaaaatattatcaatagaaaggtgaaaccatggaagaagaacagagagaagggaaattatatgtaccatatgtcaaagcgagaaaggaatattttccagggtttggccaggaagaattgcatagttcaatttttttgattatgtttatcatcattggtgctgcgattgcttatatggtatatccagatccggccgttgttgtattaacaattttgatcggcgtggtcggatctattatgatgtgtacaaaaagtgaagcaaatgtaagcgttgtagacttcataaagtcgatgatccgattctacagatctcaacaaaaatttttgtatcaataccaaaatgagtgggaaagaaggaaaaaataaaaaggaaggagaaggatcatgattgtttttttagcaagtgatggttattcagatttgctgcaaaattctgaggaaaagtttatccataagtatgtcaaatggagatatgatcttaatttctttttaaaggaagagtatgcaaacctaatggccatgaatccggaatggattgtcattgaggaaaaagcaattgatgatccttctaaaatagatggagttattcaatgctttccaagaacaaagtttatctacatcacttcccggaaaaatgaaaaagagatcaatgggaagtgtagaacgatttatacggatggctttttaaagaagcggctggaatcaattctatttgggaaaaaggtaaatctgcagcaagaacagaaaaagattggagtcatcacagatcaagatcctgatcttgtaaaaagatttacgttaaatcttttgtattgtatcaaaagatcagagcagctactggtttatacagaagttggccaagagtccagtttggaagaaacagcagaaaagtatgggatgttaaagaccgagaaaggatatgagtatgatggtatcccggttctacataacctggtgattagccaggctcttatcaacctgtttgatttcggagtcacagacgaaaagaaagaaaaaatgtttgagaaatgtgactattgtttccggatcagcccggaaggaaaaaaaatcagagttgatctgcagggacagatctataccatagcagcgtttgaacatccgtttaaaccaggccaggaacgtttttatgcagatttgttgccggagctacacctgcaggttccggacgcaaaaatgaaacgatatcagcatctcatgaaagagccaaaaaagagaaaaggaccaaagaaaccaagagaaaaaaagaatccagtgaaacgttttcaaaaaaaggaacgaccatcaaagataaaaaagccgaaaccagccaaaaagactgggacgaagataaaacttaagttaccgaagagttcctttccaaaattaaatttttctgaatatgtaacaaaaaggcgcttgatggtttttgttggaaccttagctttcataagcattgtggctgctggattccgaaccttttctgctggtcagaagaaagaaaagatcaaagaagcagtcaaagaacagcaatctacagttttgtcatccacaacagaaaaaacaaaagaaacgtcatcagaaaaagtcacgacaactgcgaaaaagaagaaagaaaaaccaacaaccgagggcaattcggaacccagccaatcgacgactgcagccgccgtaaataggacggacgcaactagacgtttaagccaagaatcaagaactgcaacaaccacatcaaaaaaacgaccaaaacctacgactacaagaaagaaaaaaactacgacgacacagaagaaaaagcctacaacaacacggaggccaaagcctacaacaacagaacggtttgaaattgagcatggaccagattagatctactatttaggaggatagcatttatgaagaaattcgtgcaaaagcttatgataaggttaggatattttcttagtctattaattgcagtatggatgatagtgacaaaagaaacagaatattttttagtgatcatagcattgttaatcatcttagattttttaaaagaaagggtaaaaaggtgatgaataaggaaaatatgcgtctatgggataaaaagcaaaaaggatgggttgaggagcctttctgggttggaaccaatgatacttatgttattcaaagcaatggaaaatttcaggaagtgagtgctgaccaatatattttacagaaaagtacaggaaaaacagatcaaaatttaaaggaaatttttgagggagatcttgttgaaagtcaagtgggtggacagaagatagagataaaatatggcagatataaagctttctgtccagcggatcaggagtatatggacaatatcgggttctatgctgcctgtgaaggatatatggatatgccgattggcccgctggaggagtatgcggtttggatagggaacatttttaagcgaggagatgaaaattaaggtgaaggtgatcattttaaaattttgcggactacttttagacctttttgtgattatatgctttgagtttatgcaggtttttactgtgttagcttatagcaatcaaataggcacgaaaaactggggcgtttttaaaagtattttgattgttatgaatttggttattatatactgcatgagaaatttttttaagagacatatgctaagtaacaagttaaaagaacaattaaaataggaaatataagtttacttagtatggttctcatttttttatgaagatatggtgatgaatgagtttccatataaacatctgaaataataatatatatcgtgaagaatagtataatcgatccaacgattggaataaaaattatgaatgataataaaacagtatgtaaatctaatgcatcatttgcgataggtgcataggaaaatttcattacatttatgtgttgtagaatttgatttaaaaagatgccacttacaaaataaataataaatgtaaattctatcacatatttatatggtttttgtttgaacagattgataatcagggcacataatgctgtatttattaaaagccaagatagtgtctttaacagacggtagcaaccatagatgataccatttgccacaggagttaaaagaaatatatctaaccttgaactgcccataaagttaggaatggattcccaattatgatatgtaaaataaactgcaaaaataatagaagcaattaagcttaaataatagtagatagttaaaatggtttttttgttttgatatgttacatcaggatataaagaatcagctgtattaacctgataatttttaacagatacttgaatatttatatcggaagaagagtttttattggataaacgatcttttaaatctaatataccaataattaaaccaggcagagcaatcaatttatcaataagaatattaaaaatgtcgaacttgttcatataaaaacctcacgtatgaattctaaatattaaggattacttatcataaattttaccatatttagaaagacaatcaagtgatagaagaaattaaattcacggttagagtttaacgaaagggtgagaaaggatcatatacaatggaaaaagatatctatatcacgaaaaaggggtggttgagaaacctttctgggctggagccaatgagacttatgtcattcaaagcaatggccaatatcgggttctatgctgcctgtgaaggatatttggatatgctgattggtccattaaggaatatgcagttatgataggaaacattttgaggtagaagatcaggattaaaataaagaaggataatcagaatgaattggatgaaaaaaagaaaattaagattgaaagaccaagaaacgttaaaaaccgtacaatatgtttttcttaacaatgcagaaagatatacacgaaaaaccattcaaaaatatggctatgaaccattttatattttagatatatgtaaacctcgtattttaatgtttaccttcaaccaggaaaaacaagaatttaaattttgggatcgatatatctataatgaagaattgcctcactatttggaatattggacagaggtcaagttgaaaaatgttacattagagcaaattcgagcaattatgcgatcctatgagaaatacaaattgcagtaagaaaggataaataaagggagaaatggaagatgaaagtattgtttatcttaggagtgattgcctttgcactttggctaattggttatccgatttatagaaaaagaaaaaaattgagtgttttcattgatggaagtatatacgcattggttttaaatgtattggaagtctataaccatttgatgagacagcgttttaagaaaaaaggattgcagaatgattctgcagttcttttttgttgaaaacttttaaagaatggggcaaactggaacaaattctatgatatactatataatgtagaacatagagagagagaataggaagttgttccattgttactgtatattttaaaaccatagaaggaggtaatggtatgaaagtattaaagaggacagcggctatgacgctgacggcgattctttctctaagtctactgccgggaaccggtgtgaaagcagccaaaaagaaactgagtgtgaacaaagtctataatacgactgcaagagtgaaggggaagaccaaagggaagtatgttgtaaagatcaaggttgggaagaagacatacaaagcaaaggccagcaagaaagggaattacagtgtaaagattccaaagcaagcagccggcaagactttatatgtcagagcctataaaaagggcggcaaaaaatactatacaaaaaagaaattttatgttttggccaaaaccatttctgtaaagaaattcgccaagacttctaaatacattaaaggatatgcccgtccaaaatacactgtaaaaatcacaataaacggaaaaacatataaaaagaaagcaagtaaaacaaaaggttttttttctttcaagatgaaaaaggccgccggcaatgcaatagctacgatccgattgtataataccaaaggtaaaagggtaaaaacctatacaaagaaagcttacaatacatccagttccagcaaaccagcacctgcagctacaaagattccaaagaaaacggatccgatcaatgaagttcagctgcagaaggatattgatcaggtcaatcggacaggaaaatatatcataggagagaacgacggaaaaaatgggtatagatattttgtaggtaaagaaggttggatttctgtgggatatgtaatgaattatatgtatacagaagctgatggagcacatgctcagtttaaagccaatgatggaattacattatattttacagtaagtccaaatcgcttgaccaagtttgagtggccaactacaagcaagtatgatttgaaactggaatccgggcaaatccggagattccaaggaacggagtttaaggagttgccagatgacaacctatattttaaagtaaaaggatataaaaatggaaagctgatcttgatgcaatcatctaaacaatatttaattgcagggtataatgacagcatgttccaatagaagtagattatttaaggatcacagagaattctgtggtcctttttttgtactcataataaggataaggagatgaagattaatgtatacgaaaaatcgtagtccaactaaagaaagagaaaaacatcgcgaagctggcgatgttttttatttacaatcaacacttgacttacatgtgagtaaaggagacttataaatgaagagaaaaaagaaattgctgcagaaaatagcagttatagctatggcagttttgatgctgcctactacagttttagcccaagtagataccaatggaaccgtggaaataaaaaagggtactagtgggggtgatgcatggataatagataacacaaacggaggatattcttcttttgacgactctaaaaataaagctttaaaggtaaataactcttacggcttccgcctgcagaaaacagatcagacgaagttttcagtaagtgaaggaaataaatccagtgcaccttccaccttccaggggaaagatctgaaccttccatcctttttgaagaataattacttctggttcaagacagaaaataacaccgcaaacaacatccaggtaaagcggacgaatcttaaactttatcaggatgggaaatggatcgatgttgatctagtccgaaccataaccggctttgaaaaatataaaggagaagaaggatggatagcattggggcaaggcatttcatctacagcttatgtcggattagaagaggtaaaaactcataatgttttctataaggccggaactactacaccgataaaaatcaaaagtaatgttactcttaaagatattgatgacagccaatatattgcaatcaaagcagataaagttgttggtcagtatgtttcttctaatacaaaacttaattacaaagaggataatggtactctgatctacgcggataaaaccgggacgaactatgacagtgaagcatttacctgcgtagccttcacgttcgaatcaacaacatttgactatacgtttggccgggtcagagctgaaggaccaagcaatcaggagcagtatgtaggatccggacaaaatatgtttgtcgtacccccagtacctccgacgaagacagtctctgacgaagatgaaaccgatgttacaaaaaatacggtcagagacttaggaaaaagctggacttattctgtatcccagccgatttctcagggaattccgaaaaacttctattttgacaagtttatattcaaagacaccattgaggagtgtatgaagatcgtgagtgtaaaagtagaggcagaggatgccgatgcggagatcacagacgtaacctcatggtttaacatttccacagcaggaaacaacgtgacagcgacactcaagaatccagatgcctccaacttttatgacaatacgatttatactctgaaggttaaggcaaagatggatgtgccggaaaatgcaacggcagcacaactggaaacactgcggacgaaatggacgcagcacggccattataattctgagaaaaagattttaacagaaaaaaacaaagcgtccacggtgattgacgaatataatcagcaaacgaacgaagtcagcacggatatccatttatctacagatgataaaaatgagccgggacttgcagttacaaaaattgtagacaaatatgagcataaagtcggagacaaagtaaagtatacggtaacagcaaagaacacgaactccaaagcagacacggcatattttacgattcaagatcttacgcttccggcaggaatgagtttggactttaaatctcttcaggtatccggcattgaggctgccaactatacgttagaacagcagggaaatggctgggtgttaaaaagtaagggagactatgcattgccttatggaaccaccattacggttacgtatgaagcgactgcagcgggtgaggtcaatggcaatgagattatcaaccgggtaaaagcttttgccgccgggattccagagaaagaagcaaacgcaaaggtgtggatcaacagcccggatctaaagattaccaagaaagcggacaaagaaaaatataaggtaggggacactgttacctataccgtggatgtcagccaggaagccatcggctgtgtggccagaaacatcgtgttaaaagatgttttaaaaacagagggtgtaaagctgcagaaaaattctgtggtcgtcatggatgccggaggaaacatcttaaaagatgtggatgtgactgtaaaaaataatgattttgacattgtaacccataagaatctggtgtgcccaaccgataaatactctgtgtacgatggaaagctgatcaaacaggataaactaaatcctttgaatgtgacaaaggaaactgcttttaagattgaataccaggcagttatcacggatgaacagctttccggccaggaaatcaccaatgtggccacggtcaatagcgatgaaaatattccaaaggaggatgaagaaactgttccgatccagggaccaaatcttgatattacaaaaacttctgacgctggcgtctataaagtcggagataccgggaagtatacgttaacggcaaaacagaccagggaaggggaagtagccaagaatgtcgtgatcaaagataagtttggaatcgagggagttgagatcaacaaagattctttcgtagtcaaattgaatggtgaaacgatcactccaaccaagatcgaagcaacggcagatagttttacggtggaaactgggaaagatctgacggatgctgataagctggaagttacttaccaggtactctttaaagaagcagctttagagaataaacaggtaccaaataaagcgaccgtgtctgcagacaacgctccggagaaaggaaccgatcatgaggtgacgatcaaaacagcggatgatccggtcctaaagattttaaaagaatccaatgaaaaagaatatttccttggagaaactgggaagtatactttaactgttacccaggagcgcctggatgcggttgcgaaaaatgttgtgattgaagacgcttttgatcagaaagggatggtgattgatcctgcctccttaaaggtgacggtatccggaaaggacatcacggctcaatgcaaattggcggtggaggatgataagtatacgatcagtacaaatgctgacctttcaagagaggtaatgaagatttcctatgatgtcttattcaaagaggaggctttgaaagataaggatatcgtcaatacagcaaaagcaaaggccgacaatgctgaagaagtccaggcccaaaattccattaagatcagcaaaaaagataccaggtttgcggtgcgaaaggatgcaaaggataaggactatcaggttggagatttgatcccatactccatcaaagtcaacttaacgaaaccaggagacactgcaaagaatattacgatcaaggatacgcttccaaaaggcttagagctgcagaaagatacgatcaaagtatccggtgtagaaaaatatgaaaccaaagtgacaggaaatgttttaacgattcagatcaatcagatggtgtatggacaaaaagccatcatcacgtataaagcaaaaattttagaaggtaccgaaggaaagagcctcaccaataaggttgaggtcacatccgatgatacgataccagaaaatacttccaagacgatcaagataccaaaaccagagaaaccggtcatttcaaaaatcgccaaaactctggaccaggcaaaaccaggacttcttgcagctgccattgctgccggagttgtaggtttgatctggctttaccggaaaaagaaacaggaaaaataatggatgatagagggatgtctttgacattcctctttttttaggaggtcatttatggattggaaacaattacgagccgttcaaagttccgatcaagccaaggatcctggctttactagaaaagacggatttgagagatatcggatggtaaagctggatccaaaaacgggggagatcataccagattctaagaaaggaaagacatttgattttttacaccaggcaatgcaggaaactccaaaaggctgtaccctggtatcttatgaaatgttgctgcaggaacagaaaaggtttagcaaagaacaaaaggggccaaagcaggcagcaagcgagaaaccttggatgattaatctgtttgccgggccgggcgccggtaagggaaaagcagcacgaaaaattgtagaggcactgaaaggaaacggcgttgcggcagcttatgtccctggaccacagaaagaaatgttaaagaaggatccaaaacagttggatagaaccataaaaacgcagaagaaattatatggcttgcagaaagagagacttaaaaaggaagcaaaactgtcaaaagtgattgtaacggattcccctctatccgtatatccattgtatgtaaagaaacctgacataggattttcaaaggaagtgatcaaagatttccggaaagatcaaagtctaaacatctatctggaaagagaagcggaataccaaaggggagatcgaaaagaaagtctaagggagagtgaagacattgatctttccatctggcagatgttaaaacatttccggattccttttatgatcagcaaccaggaaattttagggcagacaattaaagaggtagaacggcaaatcagtgaagccgagagggagccgggacaaatatcggaattatccagggaatccattctgggtattgatgagactcgtctgctttccagccgaagcgtctggcaaaaggaagcaacccttgatgaggaaccaacgttagatggagtgatagaggaagaagagattgtgatggaactaacccaacattagaaagggaaaggagaatcaaatgaataaagtcattttaatgggccgattgacagcagatccaagtttaagatatgggcagggagaaaaaccaacggcagttgcccggtaccagctggcagtgaatcgaagatttaaacgtgagggagaaccagaggctgattttctcccatgtgttgcatttggaaaagctgcagagtttgcagagaaatatttcagaaaaggcttaaagatcgtgatcagcggaaggatccggaccggcagttatatcaacagggatggaatcaaagtgtataccacagatattattgtagaagagcaggactttgcagaatcaaaagcagctgcaaatcaaagagatcatgcatctgcaccgccagtcggtgaagatggatttataaatcttccggacgatctggaaacagaactgccgtttacataaaagattgggtcttatgggacccttcttttatttagtatcatggttggccaaaccaaagaggagattagtatggcaaaaataacaataccagtacaaacaatgaaagaaatggggtttgaggtgcttaaggtaggggagaaggagtatgtcgatgtatcaccgctgtatcttgattatggacatatttcagaggagcttcagcaaaaagtcaatgtttatgtagaacaaaggaggcgggaatttggccagaaaaaaagaaaaactagataagaagcagcaaacggcgcaggactttaccaatacagcggaaattgaagattgttttttatatacaagagatggatatattgcagcatacattaaaattttaccgatctcgattgccttattgtcccttcgggaacaaaagacgctgatcaagcagattaccagcgaattgtctacggagaaggagccgtttcattttttagctgttagtcggccagtggacattacaccgctgttagatgaatacacggaaatgcggaaaaatacagataatccagtacaaaaagatctgttgcgaaatgaaatagaagaaatctcccgatttagttttagtaatgaggttgttgaacggcaattttatttttacatctatcagaaatatgcggaagatagtgagagtgaactaaagaaacatatttctgagttcgccaggcattttgaacatgcgggaattaaaacagaaattttaaaacaatcggatatcattcgattgtgtaatttagtaaataatccagcggtgattactctggaagacgaagatataaaaccgaccattccgatcttaaaagagaaggaggcacagatgaatggctaagaagcagcaaaaagagattaataatgccttattaaatgtcatagccccggttggactggaatttaaagaaaattcattcatccttggagaaaatttaggcagatcctatgggattattaaatatccatccggacctgattatgggtggttgagtaaaattacgaatatcccatctactatggttgggattacatttactccgaataatgatggggagattattcaatctctaaactataacatcaatacatatgctcaggaagcggagatggccaaagatcgattaaaaaagcagagagcagaaaaatctgcgaaagacggagaaatgctcatgaaacaaattgatcagaatggcgaaaatgttggggagttaagtgtgacgatcgttccaatgggagaagacagggaatctttaaaaaaggtggagcaaaaaatgaggggtacctgtggtatggcccattgtaagatccggaatctttctttcttccaacaggacggcttaaaacacatcagcccgtttcatatggaggtgccggaaattagcaaggtgagcaatcgagtgatgccgctgcggtcctatattggagggtttccattttcatcttctggatataacgataattcgggattttatgtggccaaggatgccagtggtggattggtcattttagatttttggaaacgagagaatgatcggaccaattctaacatggttattatgggacaaccaggtttggggaagagtgctgccacaaaacatataacgctaggtctgtatatgttaggaacgaagctgattttcattgatccggagacagaatataaggaactttgtcaagaactaaatggaacatggctgaatgccggcgggtctccaaatgccagggtaaatcccctgcagatcatgccggtaccacgaaacgatgacgcaaagacagaggaaaatgatctctataattactatgacaaagatgatggacatggtcttggagatatggctttatatatcaagcatttagaaacgttcttttccctttatcttccaagtcttgacgactttttaagggcagacttaaaggacacgatcattgaactatatcatgattttggtattacgtgggataccgatgtgaaaaaattgaaaccaaccgattttccatacatggagcacttatatgcaaaaataaaagaaaaagaagctgaagttgaaaaaacaaggaaagaagccgacacgaatgaatatgctaaactggctaaattactaaaagatgccagcgagggggccgattccatgctgtggaatggaccgacaaccttgaaagcagacaatcagtgtgtcgttttagataccttctctcttcaatcatccagcgagaatacaaaacgagcacaatactttttattacaaacttgggcctggaatatcatgtctgcagatcgaaccgaaaaagttcaactaatctgcgatgaggcgtacctgcagatcgatccggaagttccgcaatcacttgtctttttaagaaacgttgcaaagcgtgatcggaaatatgaggcaggcttgattatcatcagtcatagtgttgtagactttttggatccgagagtaaagatgtatggtcaggcactgcttgatacgccttgttacaagattttatttggatccgacggaagaaatctaaaagaaaccacggatttgtacaacttaaccgaagccgaacaggaattgctcgaatcgaaacagagggcccatgccctgtttgtcatcggatccaagaggctgcatgtcaactttgaaataccagaatataagtggcagtattttggttctgcaggaggaagataagatgattccaaaaaaattcattgatcttccgaatacagacggagaaaaagcgggaaaaaagattggtaccatcgttggcattccagtattttttctacttttgctttgtgcggggattgcctctttgagcacctcatccggaaccgctgcagaacctctttcaaaagaggtagaagcctatcgtccaatggtttctacctattgttcaaaatacaagatcggagaatacaccgatcttgctttggcgctcatgatggcagaatccggaggatcagaaccggatcctatgcaggccgcggaaggagcttatggtttatactgtttaaaaacaaagaataaaagcggggggcaccatcaaggacccaacggtattccaactggtcactctgagtgcagcatcaatgccggcgttcaggaattaagagatgccttaaaagctgcagaggtggaaagtccttatgaccttgatcggattaaaacagcaatccaaggttataactacggaatggccagatggattaagtggataaaagcccatggcggccggtataccctggcgttaagcaaggaatacagtgctacgatgatgccggccggagccaaggggacccctaaccatgccgaaaaagtaatgagatattattctatcgctactggagattcttcggcagagattctattacttgcaggaaatgcaggattacaggttacatattataaccagggggatgcagcctgggcttcgttgccctacggatcgtctaccataaaaaagagtggatgcggaccgacatcggctgcaatctgcatttcaaccttgtccggaaagagggtgaccccaagacaaacgtgtacttgggcagcaaataatggatattatgtatccggagccggaagcaaacatgaagtcatcccagccttggctaaacattacggattgaaatgcaaaggagtgggtaaagataagacaaaagttgtaaaagccttaaaaagtggaaagaagttagtgatcgccattatggggccaactcattttactagcggcggccatttcattgtgctgagaggaatcaaagatggaaaaattttagtagcggattgcggatcaaggcaaaggacaaaagagacctggagcctggatttgattacacaagaagcgaaagggtcagcatctgccggcgggccattctggattatatcaaagtaggaggaaacatgagaagagaaaaaataatgcagaccatcttttttgggatcgtcatggtgatcgtggtgaccatggcccttatttttcataggaaagagtcggatccgtcaacaacgacaagtacacagacggaaaccacaaccgagagtgttactaatacgaccgaagaaaccactgaaaaaatgacggaagcaccgcatgatacatccgattgggaaaatcaagagactggggaaccatccacaacggagactcccggagtccaatagacaaaaagaaaaagagacttatcgcaagtaagtctcttttaaagtaaatattgtcctacgaatatctacctgtataggttcttttattttaaaaccttttcttcacgatgtcaatgctgtttagaaaaagtttagaaataaaatggccggaaaggaacttatgaaatatcaaagcatacaaaatatatttttagatccggatttaactcctgcagcgaaaatcgttgcagtttttttatgtcatcgctcaacggcatctggatgttgttacccggcagtgcagacaattgcggatgcctgcagcctttccaagagaaccatccagcggcagctaaaggagttggagagaaaaggctatctggttatggaagaacgtttcctgtttggagagcagcttacgaaccgctattattttacgataccggagaagcgattccagacatcaaattcttatctcaaagaaatcattttagaagatccggattttttatcctggatggatcgagaagaaattgatacaaaaaatcctggatataaggcagagataatgacggatgtttttcattcccagaatctttcctcaagagaaaagctggcagccttgtatcttctatttcatgcagaccgggaagctatggcatactttgatttctttaagatggcagaagaactaagcttaagcagtaaacgtctgaatgcgatcttacactgcttagagcggagaaacatcctgcattctatgaaaaaacatcatcgtggtcagatgatttatcttgtcatgctgaaggaaataaaaactacactaaatcccttctaccgcccatattatctgttttatttgtatcatcgaagtttaggcaaagaagatcaaagtgccttaaaagagccgcaaacagcaataaaacagacgaaacaggaccatggaaaacaactcccatggttttttattttgatcaaaatcaggaagaccaaaagtgtaggcagaagggcacgtgccccttgattgtataaaatgtcacccagtttaaaccatgggttatgaaataaaaagggttattgaaaaaaactatatctagtagatatctaaatcatttaaaggaggactcatgagaaagaaactaatgaatcttttgatgctgggactgatcggtgtcattgtatgctgcagcatccttctgtttcagacagaaagagaatataaaaaagcggaccaggaataccaggaaatcgcaaaaagggtcaaaaagataaaaaagaagaggcataagagctgcaaaataattgattttcaaacgctgctgaaagaaaatccagattctgttgggtggatccaggtcaaggatacccagattgactatccaattgtccagggaaagaacaatgaaaaatatcttcatgaaacgtttttaggaaatagaaatccatccggagccatttttctggatgcaaaggcgaaaaaggacttctgttcggccaatagcattatctatggacatcacatgaaaaatggatccatgtttgcagagttgttgaaattccggaaactgtcatttgcagaaacacataagatttcactttggacgccgaaaaaaaagcttaggcttaaggtcttttcagcatatgcaaggaaagcagacacaacactgccggtggagtttggaagcgatgaaaaaaagtctatgtttataaaagagatcacagaaaggagtgaaattaggggaggtgtaagtcaaaaggagctaaggaatgcaggacagatctatacgtttgtgacctgcagctatgaacatgacgattatcggacgattgtccatgccatagaaagggggtagagagtatgcgattagaaacattaaaggatctgctaggagcagaagaggatccaatggaaattccaaccgaagaactgcatggggaagaactaaaggatgtggatgattttattaatccagggaaggagaaaatggatggccagcgcaattgaactagtaaaacaatcccgaagacaactggtagaggaaatcatagaaaacatgaaacagggtcatcttttttcttctgagaaatgggatcgtaaggctcttaagccctacaatccagtcagcggttttcactatcttgcaggaaaccgtatacgactgaccatggctgcgatcaatgccggctatcaggatcctcggtggatgacgtttattcaagccaaaaaacagggataccacgttaaaaaaggagaaaaaagcactcttttagaaaaatggatctttaccaaagaagtcaaagaaaaagatgaacatggaaaaaaagtaaaaaaagtagtccggttagaacatcctatttgtaattattttcgtgtgtttaatgcagagcaagtggatgggatagagacattgccggagcaggcggctctttcggaagatgaaattttaaaattggcggatgagatctttcattcttctaagtgcgccattatagaggctgctcaagagatggcttattattctccagaagaagaccaaattgtccttccacctcgtgcattctttaaatctacgacagcttttttatcggttggacttcatgaaatggcacatagtacgggtcatcctgaccgtttaaatcgtcctctggggaatcaatatgggacagaggaatatgcacgggaagaattaaatgcagaactttcttctgcatttttggaagctgatcttgggcttgaggtaaaaggtgagaggcttagagaccactccaactatctgagatcatggatcaagcttctgcaagaggatccaaatgaacttttccgagtatgtcaaagtgcggaaaaaatcagcaattacataatggaaaattacgaagagtacatcaaaaaggagccattaaaagaacttaagaatcacatggagatagtagaaaattccgggattccacgtcaatcatggcgatatgaactgggagtagacaaaacaatgcagcggatgttccaaagtagacttccagaagaatttagccaggtagatgtgcttaagcatatgttgatatccggagaaattacagatcaaataataagagaaattaatcagccagaataccaatatcagtcagaaaagattgttccggcattgtccgagggagagaaagcaatcattgatgaagctgcagaatatgatatgactccagaagaattttatgaaaaagtctcttctcatcctatgaaaaaacattcacaagatttaacaaatcttgtgaatggggtcatcttagctttggagcagggaaatgggttcagtgaacaaaaggttttagaaaaaacttcagtgatagaagaagatctggatatggaactttaaggaggagacaatgcagcacaagtatagattgaccaatgaaacaaaaaaggtacaaggagaaactgtctatcggatacaggcattgagagattttgcagatgttaaaaccggacagcttggcggattcattgcaagcgaaaataatttatcgcagtttcatactgcctgggtttatgattctgcctgtgtgttaagaaatgcctgggtagaagaagattcaaaagtaaaaggaaaagcagtagtaaagggagatgcaagaatctctggacacgctaaaatatctgggaatgctacaattgcaggatattcatggattgaagaagatgctagagtgactgggtgggccagtgtaagggggaaatctcatatatgtggaaatgcgtgtgtgtgtcatcgagcaaaggtgaaagatgaatttttatacaatgaggtggttaccggaccagtcctaagttcaaataaacttgagacaatgggtccggagctagagccgcagagtttatccttgtcaagcgattcatttttccaacaggaaaacgatgtggaatttgaactctgaaacaattcaaatagagaaaggagaagcaaatgaaagaagaaaagcaggaaggtatgagagagaaacaacaaaagcggcttcaagcatatgcggagaggtgggggaaaattacgaaagaaaagaaggaggagaaaaagtagatggaatacaaagaatttgaactgtcaaaggatttgatacattttgacccggaaaaaatctttttccgggtcattggagcaaagcaaaatgtagatttgttaaaaaccattcctcatcaattagaagaagatctggcaatcacctatcatttctttgtagggagaactgatggaggtcttataagtgctccaatcgatcatcagatgctaaagaactatcaaattacacaggaagaattacatcagattgcgatgaaaaatacaccaaagttatttccagctgaatttcaatctatggcagagatcattccattttatccagtgccagattatatgtatgttttaacaaatacctatatggccaatggcgcttctgctttattttatccaaacatgatagagcagataagggaacagctaggggatgacttctacgcacttccatcatccgttcatgaaatgatcatcttaccggcgaaaacagcggaaagtatgggggatattcatgaattgatggaactggtgcgggaaataaatcaaacggacgtagtgaaatcagaagacgtattagcagacagtgcgtaccgtgtagacgatcaaggatttactaaaatagaagaacgaaagcaagagtacttatggctcaaagaagagctattagaaccggtgcaatcctttgaccaggtgttggatcaagaaactatggaagctgaaatagaaccataaggaggaattataatggcagaggaaaatgagagaaaaaaacagtttgacgccagacagttattagagattaaaatggggatccgaaagaaattggatactcaaatttataacgatgtcaatttaaaagcagaagaaatgagggagatccgtttaggcttggaatcaaatcttgatgtttcaaagtatataaataagggatttcaagcagaacagatggtgcagattcgtgtgggcatggaacaaggacttgatgttgatcaatatttgaatccggatttaaatgcagctcagatggtacagatccgtaccggtatggaacagggacttgatgtaaaagaatatgcaagccaaaactatgatgcggaacagatgaagcagatccgtatcggaatgaagttaggtttagatacaaagcagtttaatcatcctgcgatgacggcagaacaaatgaaagatcttcgtttgacgatgaccactcagaaggtaatggataaaatcaaagagcagttgaaagaaattttggactctttcttgaaagctacgaatttgtacattcactttccatcaaaagaagtgcagcatacaatgagtcctaagattaccgaagctttaaatgagagggcgcaagaggttatcaaagagagggttttagaagcagaggtacaaaaggaaccagaatctatggaggaggttgaggagcaagtaagcgaggatctggaaaaaccagaaattcaggacaaaattttagacaatcagacgatagaaaaagtacaagacatggtaggagagacaaaagcgcaaacgattaaacagccttcaaatgaggaagaacaacattctagcgaggaagtgttaaaagaaccagaagaaataagttatcatgaggatccaaaattgaatgaagcaattaagaattatattcaataccgagaggaaataggttttccaatgttgaagtctcagattcagccaacgattgaccatgttgcctttatggatcatgatctttctcatcaagcggaaatttttaatcaaacggttacaaacggatggaaagcactttatcctttaaagaatcagagtcatgaaaaaggacagggaaaaaatcagtcctatggaaaaagtaagatagaagtaaacaaatttaataattttgagcagcgagattatgattttaacaagttagaaacagcattgcagcaaagaacatatcagccggatggattaaatcaagtgccgcaggaagaaccgggtatggaaatgtagaggatagaaatgagcctcttgttttactctttgtttcttatgtcttgtttgtgtctttttatgctaatgtttttacatatctatccataacaatgacaaatgataaatttaaaaatgaccgtctttcacatacaaggattaagatcattcatataccaattaaaaatcttttcatcgaataaagccttaaaaaaatgagccttccataacttctgttcatatgaacagaagttgtggaaggtctttttttatgtccaaatcttatggtataattttattacaatagagagatttggagggtgagagagaatgatttgtccaaagtgtggaaaagaaagtgtagaaggtgctttgtattgtgagtggtgtggggctaaactaaatttagaaaatgaaaagaatgagaagtatataatttataatagtaaaaaaataattttttactattaattggttcactgcttttgattggaaattcaatatttcttatttgtgttaatagtgaagaattggctaatgtccatatttatggtgctgctcgtatgctttcaggacatccagtccttataaagggaattgcttggattggccttttgttttttggagcaggattctttatacttctatctggaagaaacttaaaaaaaccatgtcttatactggattcagaaggtctttatataggagttaattacattggaggatttaggggcaagcttagctgggaagaaattatagatatttctgtatatgaaataatgcaacaaagaatgatcagaatatattttattccagatcaacatagatcgatgtttaaacggaaatattcaatcatacaaaaagtaaaaaaagggtttaagacagcgtatttaccatttgttacgatggaagaagatgaaaaaatagtaatggaacaaatacataagtatgaagaaaaatacaaaattgggtagataaatgaagttcccagggtgttaattgaccctgggtcatgttcctattttttaagatacagttgtcttaaaagttccagagctgaagtgtatccagagtagaatccaatttctctgcagcgggaaccgtaatctgttttcaaatcagacaatatcacttttttgcagttttcaatgtccagatctcttaaatgggtttcgaattgctctgaaatcatgcttaggcaataatcagtcatttcatcctctaagtaacaattatacagtaattcttttaaatcaaaattcatatatcctccttctatttgtgtgaattatgctatagtaacgatgagagacttaggaggaatgaggaaatgatagtatataaagttaacatgataaaggaactgaaaaaacttggtttggactatgctgcaatgaaaaagtacaaaattattagttagtgtacgatgaggaagtttgtgaaagatgatgtttatatttctattaaaacactaaatacactttgctgcgtactgggtttacagccaggagatgtttttgaatatatagaaactcaagaggacagagaaaatatacttgatataataaatgaagaaagggaggtatgcaattttgaatattgatcctgataaaatcaaaaagttagtagaaagttttagtgaacttaacgaagaaaatcaaaaggaaatactgtcaaaaattatagaactaaaattcatgcaagtacagcaagataggattaaggatgaagcgttagaattcaatgcggaagaagacctacaaaaagaagtaagaaaaagaacgaacgaacatatttctaaagttgcagctattattgaaaaaatcgatcaattgaatagtgacgatcaagcaacaatggcaattttaatgaaccaattatccaatggtaaattaactaagcaagttgatatttccgtaaatattacggaaagaaatttgactatgaaggagtttttagagaatcagttaccaggtgtggattatgaaaaggctgcagttactgtgaaaaccttttttgaagaatataatgcacagaaaaaatagatattgtggttttgattccgaaatagtacgttgaaaggggcacatagtgatatgctccttttttgtatgaaaaaataaggcgatagaaataataataaaaaatgtgtggttttatggatgtcctacataagaaaattatcagtatagagcttagagagaataaagaaataaagttgaattgcttcaaaaaccgaataaaatttaggtttctccaactttgattcatatgaaccgaagtttagcagtacaaactaagaagatagaaaaaatgtcgggaaaccgcataaatacaaaggttttgagacttctgttcatatgaaccgaagtgatggatggaaaagagggattgggaaacctcccaaagttaaaaaggggattgggggcaccccaacaagctattcgtattacgaataggaagcttgcttaaatagagaagaatagaatctaagagtgagaaatcattgtccatggatgagggttattgaaaaaaatatcactctatgacaaaattcaatttttgaaagaagagatgtttagaatgaattgacaaccacgtatttacgtggtataacatatagtatagaagggagaacgatatgccagagatatcaaacttttttggaatcagaatcacaatgtactatgatgaacatagaccgccacattttcatgcagattataatggtaagaaagcagaaatagacattcggacttgccgggtgattgtaggggcactgccatcaaaacagttgaaactggtgacagcctgggctttgattcatcaagaagaacttatgcaaaactggaataaaatcgagaaggctgagggaaatttaaagaaaatagagcctcttagatagaggcccagaaaggagcgcatatggaatatttaccggaaatagaacaggttgttcctacgttggattataaggtctacgtttatatggacgacaatacggttcgcttatatgatgctgccccattgattcaaaggggtgggattttcaaaaagctgcaggataaaacattttttatggagcgctgtaccatcatgaatgatacactggcctgggatttatcaggcaggcttgatccggaagactgcatagacatttgtccggataccattcgggaatgtgagatagtcgaggacatcgaagctttggaaaaggagctgtttgcagttgaagcttaaagagataagagaagaacggaagttgtcgaggccggcactgtcaagattgtctgggatcccggtcaggacgatcgaagatcttgaaaaaagggatgacggaagagtgtctactgtaaagaaaattgcagaagctttggatatttctatggatgagttatgtaaatgacaactgttctggaatcaaaattctgactccagaacagcaaacactgtggatattaggatacaaaaagaaaaataagaacatgctgacaattctcaaaaagctgataaatacaggggttgagggacttctgttcatatgaacagatgttttttgtcataaaattatattgctgcaatagccacttgatctggttgaatggtcaggtataatgaccgcaaaagattggacaatgaggaaagggaaagaatgattgatataaaagatttaaataaatacgagcgtgatttttccacttattatggaggaagaagtggatctaaatatgcgattataattgatggagaacgatggatgataaagtttccagaaaatacgaaggattttctgggaagagaaaaaaagaacgcccaccttccatcttatacagccagtccattaagtgaatatattggttctcagatttaccagtcattgggaattcctgtgcatgagacaatgttaggaataagggataacaaattagttgttgcatgtaaagattttgatcctttacacaggctgatagaatatggacagataaaaaactcattgacagacacagaggtagaattggctcacagttcatcaggccagcaaggagaagctttgtcggatgtactgaatgttatttccgctgcaccggtttttcaaaagacacctggggtgaaagaaagattttgggatatgtttgtcgtagatgcatttattcggaataatgaccgcaataatggaaactggggcatttttattaatgcagacggaacagggaaaatggcacctgtttatgataatggaaattgtttgtttaataaacgcaatccttctgtggcagaaaggaggattgcaaatgaaagagatatctatcaggatgccctgggtaccggtgtttctttttttacagataaaaacgataaaaatattcatccatttcagtatatcgaaagcgctgaaaatcctgactgtacagatgcgttgttaaggtttgtaaagcatttggatgtaagagaaattgataggattgtcgaagagattcctgagaattttcaagatatacagattataacagcggtgcaaaaagaacactataaagaggtatttcacatgatgttaaataaaagcatttttcctactgtagaaaattttcaacggaaaaagcagaagacctatcagttagatgatgtgaagttagaaagagtggaattaaatgagttagtacaagatgaagaactggagctgtaaagcaaaagaaagtattctaaaatccgcataaaataaggaattgaagcactttggttcatatgaacagaagttaagtgtgatgtgaaaatagcagcctatgttctgggtagtagacataagctgcttttcttcgtattactctctggaaagataaatgatgttttctttacaccctatttcatactttccatagtcttcttcatactgccttcgaaaaagctgaatcatcaaagataggatataatctttgttatccttatttaaacggttaaaataataaattagttttcctcttttgttcatattatcatcctcctctaatatagaaactgtataaaaacagaaaaagagatagaattaaggaaaacgtccatgtgaatggacaaaaattataatttgaacaaagtataaggatccactttaagagcttttccgatctctactatttctttcaaagtgggacttgacttgccattctcaatatcgttaatgtgggaatgtttaagagaggttttcatttccagggtgcgtaaagaaatacctttttccgaacggatttgtgcaatataaatttcgatatccataactataaaaaactcctttttgatagtatggccacaaggcataatgatactgaggtaaataaatacaacttacgatgaggaaatgattgagaaaagagataaaataagaaatcatattgtatggggaagaaatcataaaaaatgttataaagcaatgtatatctgatatgcttgtaaagctgaaaagcctgatggaatatacctttgaagcactttgactcatatgaacagaagttaaataggcaaaaaaacaacttatgctataattcataagttgttttttcgataattaatctttatagagatatattatattattgtatttttctatatcatccccttgatcatgatattttatttccttattcggaacttaaaaatatggaacaggaatcaaaagaaattgcagtggcaaatgggattacgaaggtatttattgcaaccccatatagccagatctcttttgaacagggaagtccggtactcatctatagaaaatataatgggaatggaagtagaatgtataaatcagttgtgacatcgttttgtaccattgtgaatcaaattgatgtatgtgtgaataaacaatatgcgtatgacctaaaggaattccttgcactggtgggcaacaaatctgtctatgatgaacaaacattaaaaaagatttatttttctgggaaaaatattgttgttttagccatgttatataatggatatcttggtgcagggcataatataacatataagcgattaaaggatgggcagtatcttactgaatacccatatttgatgaaaataagtcaacagcagtttaaagaaatattagagatgggtggtaaaaatgtgcaaaatactattgtcaattaatccagaacatgtagaaaatatttttaatggaaaaaaaagtatgaatatcgaaaagtccagtgtactaggaaggtggatggaattctgatctactctacagctccggtaaagcaggttgttggggaagcaaaagtcgatattatgaaaattctttatttgcggttgcatataagttgtatgacgttatcaagtatgattaaccaaaatccttgtctgactatggcatttcaaccgttcctcaatcttttcaataccttacataattgagaagctccataagtatcttctgttgttctcaaacccttataatcaaagggattaagcaacttatgttccagtggaacataagttggttttcttaataaatcattctttatagagataaacaattttatcatgtgttgctatatcacccctttgatacggatactttgtttgacattgttctcggaaaagccgaatcataagcgataaaatataatctttattttccggatttaaccgagtgaaataataagcaagtttcttgtgagtttttcttttgtccattattcatccttctcctttgtaaatataaagggggatagggcattacaaaggataaataaatataaattctatcttctgtacctgcatcattgcttagtggtgtctgcataaagaatatagaatttgcaaatattttagcataattcagaaatgacataatgtatcttattaaaaaaagataaaaaagtctggaacccgtatgattattaaaaggttccagacttttttatagtgttatttatctaagaaaaattatattaaaaaagagaaaaaagagtttttttagacgactcaaatttctttttagacataaatctttgtatcaattatctttccatattgttttaaaatatcatcatttgaacaccaaggaatgccttggtcaggaaaaatcaaatcttgagataggtgaattttatataaaataaggttggaagcagcttgaactgcttttattggatcagggttttcaatttcctcaagtaaattaatgggatattgagatttgccacaaaaaacacaataattatgataatatttttttgctaatttgaaattataatgtcttttaatatgttctaataattttggtggataaaaatccaaataagaatatctttctacaaaattgctttcccaaagactacaataattttcttcttcaaatgcccaaaaggtatctagaccaaatccaataacatcaatttcttttccacaatttgtacagaactgcttactttcaattacaaaaatatggtcacatgcaattattaaatcatcattttcttcacaaatccattttctaaaattatcatatttatgataatctggggcataccatttctttctttgaggatcccaacgagcacccaaattttttgcttcatctttttcaatataaggcacatttaaatataacataatcatttctccttaaaaataaaactaagaaatctcttttgaagggagccttgaagtttcgttttcctgctctttaaaaagttgaaccatctggccacgaatgagatcttggttttcttcattaagtcgatcataataatcaaggacacgttgttgttcttcatcaagtgaagcattagaagcttcatcatccaaacccaaaaaatagtctgcacttttattatagaatttacaaagcgatattagcttatcaagatcagggaaaaaattgcctctttcccaacctgtgtaggtagacctgcctatatgcattgtatctgcaacttcactttgagtaagttgtttgtttaagcgttgtttttttagacgatctccaatgatactcatagaatttacctcgtttatttttctgggtgcaatatatctaattatatattaagaattttggtattggtatagatgctgattattacaacggaatgttgacttaaaaacgatattagtctataatacaagtataaagtctgaaatacagacaaaagttctttgaaaattccatagttgtatctgatacaaatccagtacagagagcggaaattccacgccgtgatcatcagggggtgatgagtatgtagcgataaggggaatatctttgagaagcctggtaagctgatcttgcgatgatctgaactgagtgataatgatacttctgcatagttgctttccttgccgggaaaggagcggcgatctgtgtaagagcagacgacggatagagtgcagcttgccataaaaatggggagatctacagcaaaatcgctgtgagatatgaagtccttaccaggcttgtcagaggcaacatttacttttttatttatatcaatgagcataaactattatgttcgatgatatacatagaagagaaataaaaaaggagggaagtacaatgaccaatatgccgttaaaagttcataatgttttccctaagtacaagaccaaggaagaaagaaaccaaaaattacaacaagcttatctgagttccgtgagacaaatttatcacatgaaaagtaattccagattatctctaaaaataaagtgatggagtgataacgtatggatgcgatttatgcaagacagtccattgacaaaaaggatagtatttcaatagaaactcagattaatttctgtaagagagaatcgacatcaccagatggatataaaatattcagagataagggatttagcggaaagaacatgaaacgtcctgattttcaaagaatgctgacagaaatcaggagtgggataattaaaagagttattgtttataaaatggaccgattcagtcggtctattttagatttttcagaaacatggaacatcctacaggaatttggtgtagagttcatttcaatgaatgaaaagtttgatacaacaacaccgatgggcagagcgatgctctacattattatggtttttgcacagttggagagagaaactatttcagagcgatgcacagacaattactatgaaagaataaaaaatggtgtttggccgggaggaccggctccattcggttttaagaatgcagaaataatcaacgaaggatatagaatgtcaacattgaattcagatagtgacttggaaattatgatcgacaactttcaagaatatgagaaagaagggatgtctttaggaaagttagcaaagaaaagaactcaacaaaacttaaaaacaaacaaggatattgtttggaataatatttctttatcaagacttttccgaaatccagtttatgttaaagcagatatcctggtatatatgtatctaaaggaaaagggatatagttttagcaatccggtagaggaatgggatggaacaaaagcagctcatgtggtagggaaaaaacaatacatatcaaatggtaataggattaacacaaaagcaccaagacagacagtgtctctactaaacatacctggaacaattgatagttctttatggcttgcctgtaatcgaaaattggatcataatgcacagataaaaaactctggagcagggaaacatacatggcttacaggcttgatcaaatgtggtcagtgtggatatgcactaaggattaccacctacaaaaataaagaaaacaagataatgaaatacttgatgtgttcaggacattcaaatctgcactgttgcgatgtgaaaaaatttgatttgctggtggaggatctggaagaactggttgctgaagaattaaataaagcgatagaagaaaccaaggttgaacaaattgagatgacagatcagacaatggataatgataaaaagatacggctggcagaaatcgaagaaaagattgaccggctgatccaggcgatctcagaggcttcagatattacaatgaaatatttgaataaggaaatcgaaaaattggattctgaaaagaagcaaattatgggtaacttggagggacatgtacaaaaaagggatagaataaaaccgattgtcttttctgaattggactttgaaggaaagaaacagattgcccaaaattatattaggaagatacttgtttataaagataaaatggatattatatggaaggtttgaaatttttttaatctgtatggtcacaggacagcctggactggaaggacatttccaggcaggacatcattgaccgtgtctgcgataacaaaaagctggaaaacggtgcaatcatcctgatgcacactggaactgtctacacgaaacaggcccttccggtaatcataagacggttaaagtccgagggatatacctttgtgccggtctccaagatgatcctgaccaaaaacttttatatagacccggagggcaaacagcgcagaaaataaatttttataccaattttatgcgaaatatgataacatctaggtatcgcagaaacactgtgaaatacaagattagaaggtgacttagatgatatttcggtttgatatgaacgatctgaaccgggtcaaaaattttaaagtcggtaagatgaaaaagaaaacggcggcagtgggaatcctcattgcattgattttagtgggactgtactattatgtggcgctgcctgcaattaattttcaggagaccggcatatggatggttctaatcgcagttttaggagtgctgacggcgtgggccgcattgagggggatgggacagaagacgaaactgttttcgctgttttctgctctgctggtccttgtaattgtcggttttcttggagggatgattctttcaagccagctggtatcctctaaaaaatatgcaggcaggctgaagatagaaaataagaaatttgagacagacatgaaagagacggaaaagatcacagatatcgccctgatggacacggaaggggcaaggatcatcggcgaccgcgccattggctctctgtccgatgtggtcagccagtatgaggtcagtgacgactacacccagattgattataacgggcagccgatgaaagtggcacctcttaattacgccagcttcatccggtatatgacaaaccgcaaagcagggattccgggttatgtacaggtagatcctatcagcaatgaggcaaagtatgtaaagctcaaaaagccgatgcagtattctacatccgcatacttttccaggaaccttcaaagacatctgagattccagtatcccacagcaattttccagggctactattttgagatcgacaataaaggaaatccctattatatctgtccggtgctgaaggcaaacgcaggatttttcggggctaaagatgtcaaaggagccgtgatcagtgatccggtcaccgggaagagcacatactatgacgcaaaaaatattccgagatgggtggatcatgtatatgacggcaggctgctcctccaaaaatataattggaaaggactcctctccaacggctatattaacagtgtattcggcaagaagggctgtaagatcgcaactgacgactacggatacagggccatagacggagacatctgggcttataccggtgtcacatccgtaaatggagatcagtctaatatcgcatttgttcttatgaacatgagaacttccgaatccaaatactacacggtttccggagccaatgagcagtcggccatgaaagcggccgaggggcaggtacagaacctcaggtattctgcggcatttccggctctgatcaatgtaaacggagagccgacgtatgtcatgattctgaaggataaaggcgggcttgtgaagatgtttgccatggtcaatgtaagaaagtataacattgtggcaacttctcccactcaaaatggagtccagaaggaatataagagacttctaaaggagcaggggattatctctgccaaagaagctgccacggcagagtcaatgaagacaaaggagatcacgatcaaaaaggttgattttataccgatcgaaggcaatacttacgtgtatatcaccgacaaggaaggcaatgtctataaagaagaattttcaaaaaatgaaggtgcgatcagatggaatgccggggataagatcaagatttcctacgaagaagacgagagcggcatttatcagataacacaatagctggcggctttgtatttgacaaaatacaaaaaagtacttgatttttagaaagaatcattgtatcttatacctagcgaagtaatgacaaaggcgtcaaacgattcgaggattgtttggcgtctatttttttaatctgtcacaggtttccggcaggttaaattcttataatttgaagtccaaatcaggaaaggaagaaatatcttatgagcgaaaaaagaagtgtgtcagaaatgttcggatgtaacgtgtttaacgacagtgttatgcgggagaggcttccgaaggcagtttacaaagaccttaagaagacgatcgaagagggaacagaattaaaccctgccatcgcagacgtagttgccaacgagatgaaggaatgggctcttgaaaaaggtgcaacccacttcacccactggttccagccgatgaccggtgtgacggcggagaagcacgatgcttttatcgctccgacggaaaacggaaaagtgctcctggaattttccggaaaggagctgattaagggtgagccggatgcttcttccttcccgtcaggaggactgagggcaacatttgaggccagaggatacactgcgtgggactgtacttcacctgcttttattaaagagacaccggattctacgattctctgtatccctacggcattttgttcctataccggagaagcgctggacaaaaagactcctcttttgagatctatgcaggcgctggatatccaggctacaaggcttttacacctgcttggaaagaagaatgtaaaaaatgtcaatacctctgtgggaccggaacaggaatacttccttgtagacaaagaaaaatatctgcagagaaaagacctgatctttacaggacggacattgttcggggcaatgcctccgaaaggacaggagatggatgaccactatttcggaatcatccgtgagaggatcggaaagttcatgaaagagctcaatgaggagagctggaaactgggcatcacagcaaagacccagcacaatgaggtggctcctgcccagcacgaactggcgccgatctatgcaagcaataatatagcgacggaccacaatcagcttctgatggaaacgatgcggcgtgtggcagaacgccagggattgaaatgccttctccacgaaaagccgttccagggaatcaacggttccgggaaacataataactggtccatcgtgacaaatacaggaaagaatcttttggaaccgggcgataccccgcatgacaatcagcagttccttctgattctgtcagccattatcaaggctgtagatgagcatgcagatctgctccgtatggccgcatctacacctggaaatgaccaccgcctgggagccaatgaggcacctcctgccatcatttctatcttcctcggagagcagcttgaggacgtggtaaaacagctggtcacaagaggagaggctaccagatccaaacacggggataagctcgcatcaggcgtacatacccttccggactttgaaaaagatgccacggaccgtaacaggacatccccgtttgcgtttaccggaaacaaatttgagttccgcatggttggctctacccagtctatctctgacccgaatgtggtgctgaatactatcgttgcagatgcactctcagaggtctgcgatgaattggagaaggtagacggagatctgcaggatgtgatgatggaagcccatgagctgacgaaaaagatgcttacagatcatcagagagtcatatttaacggagacggatactctgaagcgtgggtaaaggaagcagagagaagaggccttccgaacatcaggtccatggttgaggcaattccggctttgatcacggaaaaatcagtcaagatgtttgaaaagttcggtgtatttacgaaggcagagctggaatcccgtgtagaaatcctgtttgaacagtatgctcagacgatcaatatcgaagcgttggcaacgctggatattgctaaaaaacagatcgttcctgctgtgatgaaatatcagaagacgctggccgattcagtcgctgttttaaaggctacaggaatggatacgggtgtacaggaatccctgctcggcgaaatcacagagaatctgaagaaattatacacggcaatcggtattctggatagtgaaactgtcaaagcacagtccatcggagaagtaaacgaacaggcacgtttctatcacgatgtagtgttcggatgcatgaatgctgtccgtgaaccggcggataagcttgaaatgcttgtggcgaaagaagactggccgatgccaagctacggagatctgatctttgaagtttaaatattaaaataaaaatcccgcggacggaattggggacatctcacacctcaaacacgtctgcaggatttttttaattatctataaaatgccagcatagtttttttgcttcctcacatcctatatttgaaagcgagggagcgagtttatgaaacgaaaaacctattttgcagttgtgtgcgcattattttttatcggtttcatcctgcggtatgcggcggatcattctgacggactttttatagcgagccagaaagaaggagaaggcggactgatggccggcagcaagattacaaataaaaaggtatatctgacatttgatgacgggccgtctgaaaataccgatgagatcctggatattctgaaaaagaacaaggtgaaagcgacgttcttcgtagtgggaaagaagacggagaaggccaggaagcagtatcaaaggatcgtacttgaaggacataccctggcaatgcattcttacagccataactatgaccagatttattcttccgtagaagccttcggaaaggacatcaagaagctgcaggagatgctgtatgagataacagatgtaaagcccaccatataccgttttccgggtggaagcagtaattcctgtgccggagatatcaaaccttatattcagtatatcgacaaagaagggcttttatactttgactggaatgcgttaagcggagatgcagtgaattttaacctgagtcctgaaaggctgaaccagaatattttagcagatgtaaaaaaacaaaaggtcagcattgtactgatgcatgacctggcggaggcagaaaacacggtaaaaagtttggactctctgatcaagactttgaaaaaagagggctatcagattctgccgattacaaaatatacgcagcagatacaccatgtgtccgttgacaaataaatgcaggtaatttagaatgagtatcaagtgtggaaaatggaccggaggcgtcgggcctctggtccatctgacgcgataatgtacataatggggttaaaaaatgaacataattgaagtagtgatgataggtgtgggcctttccatggatgcgtttgctgtgtctataggaaaaggtctcaatatgggaaagatccggaaaaatgaaatgttttggatcgctttgtttttcgggggattccaggctctgatgccagtggcaggatacctggcaggcaagcagtttgcgggaaagatcatgcagattgatcattggatcgcatttttcctgctggtgatgatcggcttcaatatggtaaaagaagggatatccgatgatgaagaggaaacacaggactgcggattttctttccgggagctttttattttggcggtcgcgaccagcatcgatgcactggcggtaggagtcacgttttcatttttgagcgtcaatcttttagaagctgtaacggtcatagggagtgttacctttgccatatcactggcaggagttgccatcggaagcagatttggggacaaactgaaagaaaaagcagagattatgggagggttgattttaatcatcctcggatgtaaaattttaatacagcatttatttttttgagaaaagaggaacacttatgaatttattgccacacatagcctttttagcggcaggctttattctgctgatgaagggcgcggattattttgtagaaggggcatctatgattgctgcaaagtttggaattccgcagatcgtgatcgggcttacgatcgtcgcctgcgggaccagcgctcctgaggcggcagtgagtatttcggcagcgtttaaaggaaatgttggaatcaccgtcggaaacattcttggaagcaatatcatgaatattctgctgattctcgggcttaccgcagtggtcagtgcagttgccatcaaagaaggaaccgtaaaggtggaaatgccctttgtaattgttatcactgtagtcctcacagctatgggaatcgccggaggcagtctttcacgcctggacggagtgatactatgggtgctgtttatcggtttttttgtatatctgtttaggctgacaaaaaaagaaggcattgaagaagagatagaacaagtgaatgcgtccctgctcaaaatgcttgtttttacgatcggcgggctgattgccatcgtactgggaagcgatgtgacagtagatgcggcgacttcgatagccaaggccctgaatgtctctgaccggatcattggcctgacagttgtggcattcggcacttctctgccggagctggtcacctcagttacagcggcatttaaaggaaaagcagacattgcagtgggaaatattgtgggaagcaatatctttaatatcttgtttgtcgtagggaccgtggcggtcattcatccggttccgtttgatacaagctttattccggatgcactggctgcgattttatcagcggcggttttgtggattctgtcttcaaaagaccggaagcttgccagaggcagcgggtttgtgatgcttgtattatttgcagtttatctggcacaattactcataagataaggagaataccatgatcattaaatcagttaatctggaaacggtctgtgggatcaccagcaaacttccggacaatgagtttccggaagtagcatttgcaggcaagtccaatgtgggcaagtcctccctcatcaacgcactgatgaaccggaagtcatatgcaagggtttccgctcagccggggaaaactcagaccattaattattataatatcaacgaagaactgtactatgtagatctgcccggatatggatatgcaaaggtcacggagtcggtaaaagagcagtggggtgcgatgattgaacggtaccttcacacgtcaaagcagctgaagctggtgttccttctcatcgatatcagacacaagccgtcaaagaatgatgtgatgatgtatgactggatcgtacataacggctatcatccggtcattattgctacaaagagcgacaagctcaaacggagccagcttcctaagcatgtaaaggagatccgtcaggaactcaggctcaataaggagacgccggtctttccgttttcttcgctctcaaagcagggaagagatgaaatatgggactttattgaacaagtgcttcttccggaacaggaacatcatgtttcagatgaatgaatataaaaaggaccggttctgtttaagaatcggtctttttttctgcctcctggctctggtcctgaaaaagcaggcggttgatcagataagcataaatatccgagtgattagacttccagtgatcgcagatatagatggcctgctctctggatactacgtttaagttgacttccagcagcatgctgtctttttctttgatcctgagccttacggtatattcatcgcgttttgcagggaaatagtcggcttccagattggtttcctctctcagctggtattctttggtcgccaaaaatgttagaatgtcatttcgtataggctcggagagctggtattcaaacatatcaatcgcttctttcccctcttctgtcagaaaataatggcttgcgtttcttaccagttctgtccgcagcatgtcttcgtcttccagttcgtgaaaagcctgctggagtttaaaataggtcgtataccctttgtccagaataaactccgagatctgtgagttgctcagcggaaaatccactttttttattaaaaataaaatcattaatttatataaagtcagaccgttttcttccatacaatccttcctttccttatgaaacatgcacttcttaaatgataccatctggatacctttcctgcaagaacagaatccatgaatgaaattgaaaaaaagacagatactacaactaatttatctcataagaatgaagaggtgatatttatgaagcaaagaaaacagtggatggtgatcgcattgatcattctccttgcagtcttatccgtgattcttttctgtgacacgaatcaggagcagagaaaagatgggacgttagttttggaaaggatggaacatcatgaccgtatatatcaaagcggaagacagtgtatgtattcataatccggatgtaaagataaaagatgtggcatccatttactgtaccgacaaagacatggaacaaaaggtgaaggaagcaaagctttttcattttaaaaagcgcggaaacgaacgggagattatttccatcttaaaagcagtggaagtgatcaaagaaatcgacaaaactgcagaagtggtcaatatgggcccggaagattttatcgtatatttaaaagaagtgacaaaggaaaagaaatgggcccactacttaaagattgcaggtgtatgcctggtcgcatttttcggagccagtttctcgatcatgagctataacacggatgtggctattgacgatttgtttgcaaccgtatatcagctggtcatgggaacgccgccaaaaggaccgacgattcttcatctggcctatacagcgggacttgcgataggaatcgtaatcttctttaatcatgcgggaaaaatcaagcttaccgatgatccgaccccgtttgaagtccagatgagactttacgagcgggatgtaaatgacacgctgatgatcgacgccggacggaaaaaggaggagcaggatgtttcttcgtaacttactccttgtgatatacggcttgtccgcaggagcactcatcgcgggaagcttcctggcattcttaagcatgattggagttgtgcctagactcgcaggcctttccaaaacgatatcacatgccatgttgtatgaaacatgcattaccctgggcggagtcctgggaacagcagtttttatctaccggtggcacataccgctgggatatccgctgctgatcttatttggactgttcggaggaatcttcactggctgcctcattggagcactggccgaaatgctcaaaagcctgccggtcttctcaagaagaatgaaactgagggacggaataccattcgtcatctattccatagccctgggtaaaatagcaggctgctggatgcaatttttgcgttagcaacgagccacagaaagtgcagataataatatatttagataagagaacaatctccatgcgaatactgccggaatataaattttaaccagggttttctgcggcgactgccgcagaaacggatgagcaaaaaagctcatccgtataaacttattacttgtgacataaatacttacacaaacgaaaggagcttattctgtcatgcacaatgaaccgacaaaagatcaatataacgaatatgtagaacaggtaacgccggcaagcagctgtcttatgaactgtgtccgtgcattttttgtgggaggagcgatctgtacgatcggagaagggatcaaacaggcagtgatgcactggctgcatctgggagagaaagatgctctcctggctgtcacagtaacccttgtacttttaagcgtacttctcacaggatttaatctgtattcaaagatcacaaaattcggaggagcgggaggactggttccgatcactggatttgcaaattctgtagcctctccggctatcgagtatcaaaaagaggggcaggtgttcgggatcggagttaaaatctttaccatcgccggtccggtcattctgtacggaatcttatcctcctttattttgggagttatttatatgatattagtccgattgggggttatgtgatgaaagttatgaagggaaagcagagtctggaattcgaacatccgccttatctcaaaggctggtcctccgtagttggggaaaaagaaggagaagggcctctcggacaggcatttgaccagatcatcgacgatccgctgttcggcgaggagacatgggagctggcagaaggaagattcatgcggcaggcagccctgcttgcgatacaaaaagcagagatcacaaaaaatcaggtacgctatgcatttgccggagatctcttggagcagatcatggcgacatccttcgggatcaaggacctggagctccctctctttggcctgtacggagcatgttctaccgcaggagaatccatatctcttgcgtctatgacggtggcagcgggatatgcagactatgcattggcccttgcctccagtcatatcggaagtgcggaaaagcagttccgtttcccattggaatacgggagccagaggcctctgtcctccacatggaccgtgaccggagccgggggattcgtaatctccaaagaaaaaagtccgatcaaagtccggggcatcacaaccggtaaaatcgtagattacggcgtgaaagattcgatgaacatgggagcctgcatggcgcctgcggctgcagaagtcatttatcagcactttaatgattttgccatgacaccggatgactacgatgcgatctataccggcgatctgggagaggtgggaaaagaaattctcattaaacttctgaaggacaatggttatgatatttctaaagtacacggagactgcggtatcgaagtttatcaggatgagactcaggatacccacgcagggggatcgggatgtgcgtgcagtgccgtagtcctgtcctctatgatcacaagaaagatgataaacggcggatggaacagagtcttgtttgtacctactggagctttgctatcaaagacgagcttcaatgaaggtgagacagtgccgggtattgcgcacggagttttgttggaaagagaggaagtatagatggaatatgtaaaagcatttattgtcggaggcgttatctgtattcttgtacaaattttaatggacaataccaagctccagccgggaaggatcatggttatactggttatttcaggagcagtgctcggagcacttggaatctatgaaaaaatagctgattttgctggctgcggtgcaacggtacccctctcgggatttggctttactctgtggaaaggaatgaaagaagccatcgaccagcacggattcctcggactgtttgaaggcggatttacagctgcagccgtgggaacatccgcagctctgatcttctcctatctggcgtccctgattttccagccaaagataaaaaaatagccgtatggcaggtaacttgatactaagtggtgccgccattgctgcgggattgctttttatatatataaaagagcgttcctgactgcagattctgctgtcagaaacgctcttatctttgtttggatcagggattggttcggtaacttaattattccggagtatgcaggccgcacatatattttacatacaggtctgggatctgatattgtgtatcgtctgtgattcccttgctgccctttggccttgtgatatagattttccgcagaagctggccttccggacaggcactgttggccggatatccggattttttgcatatttctatggccacatggatgtcacagggtttggtgggcttggttcccagggcaaagtactctgtctttatcatactgcctctgggatcatgatcacatgtgcctttgacagccagttttcctgactttgtgcatatccgggctttgacaatactgtttggttttgaaaactctttgatcggttcgtttttctcttttacaatctggtccatgacaagtttccaaattttttcgtgctggctgccagaagaaaatgatgtattcctgtcatatcccatccacacagaggcagtgtgatatggggtatatccggagaaccagtagtcgtaatcgctggtcgtagtaccggtctttcctgctgcaggcattcctgaggaaagtgcggcgggtttaccggttcctttcttgatgacatccttcatggcgtcggtgagaaggaaagcagtcgattccttcataacgagggtgccggaagaagatgagtttaagagtacttttccggactgatccacaactttcgtgtataaagaaggccggtggtatgtgcctccgttggccacggcagaaaaagcaccggtgagctccaggttggtcactccgtaagtcaggccgcccagggccatggactggttgacatcggaaaaggttttgccgtctgccgtagttttattatcaactaaggtggtaaagccaagcttctgtaaatactcataggcgacttcaggtgttacatcagccatggttttggcagacacaatattcatagaattggtgactgcttcccgtattgtggaaaaaccgcggtagcctttgtaataattgcggaccgggcgccccgtatcgagatattcatacggcgcatcatcgtaaacagtagctaatgtcatatttttcgtatccagcgccggaagaaatgtggaaagtactttgaacgtcgatccgggctgtcttgttgtaccggtagcgcggtttaaagacaggttttcggatttgactccgcggccgcccacaagggcttccacctgtccggtgcgctggtctatgatggtcatggaaatctggggctggatcactgtggaaacctgctcgttgatcacgctgaccccgttcttttttaaggatttggtgaatttacgggccatattctcggcagatgatttatctgcgaatatgagactggtgccaagcttatgctttttcatataactcagcacatcgttctccgaataactgacttccttaccatttttgtctgtgcctgtcagtgaataagacagagccacttttgtacccgccggataattatccgggtcattggtcactttatctgcgatcctctggatcttggagtcctgagtagaatatatttttaaacctccgctgtaaatggcattgtaggcttttgtctcatcatatccaagtttttctttcagatcacggaccacctgaaggatcagtgcatcatcgaaataagagttggcagtatagtttttctgctgccttgcattgatcttttggattctttcataaacattatcattcaccgcttccgaatattcactttttgtgatataatgttcttccagcatgattttcagaatcgtcattctccgggcagcattgctgttagggtgtgtgatcgggttcatccttgttgggttctttgtgatgccggccagtacggtgcactctgataaagtcaaatctgatacatctttattaaaatatttttgggatgcagtctgcactcctaatgtgccttcccccagattgatcgcatttaaatattcttccaggatcttttgtttcgaagtgattttttctaattccagagccagggactgttctttgatcttgcgctctatgcgttcgatcgtagttttttcaggctgtattccgaggatattgttttttacaagctgctgagtgatggtactcccgccctggtccagagacttttctttgaggcccaggaagaaggatctggcaatgccccgcatgtcgataccgttgtgattataaaaccgcacatcctctatggagataaaagcattttgaagatttgccgggatcttgtccagtgatacatagacacggtttgaatcactggtagataactttcttgtcacattgccgtctttatcgtaaatcatcgtgataaaacctttggagtggatcgagtccaaagaaacattcggggtattgtttaaaattccgcggatgaaacctatggacagaccagcggccgtgacgatcagtgcgatgatgacaaccagtgcatatttatagaaaaaaagcgtaaggtgtgaactgcgccgtaatttcggtgaagaaaggatatcctttttttgctttgttttttgcttgttaaagttcatgtaagccctcctatgtttagcattataacaaataagaaataacaagtaaataacacacccgtatgaagggtatcttattgaaatcacgtttaaggagagttatagatttttttacaaatgaggaggaacaaaagatgaagaaggagaaattaggaacgaattatttgaaagatggaaatgggggcgaatttgtagtatcctattatatgctgaatgattctgccagaggaagctacggcgctgcgctggagagaacgaccggggagccggatgtgcttgagacagaagaggtaagagaggcctttttgaacaggcaggaagcagaacatgtcattcggctgctgatcaaatatgaagtgacaccgatttctttttttgagagtttggatgcggtgatggagttggaggagaaaattgaaggaatactatgatacgatccagaaaacaggacagtctttggtgatagaaaaaaagtcaaggttcatcgggatcgccgtgccggtttcctcggaggaagaggctctggcagtgatagaggatgaaaagcgcagatacagggacgccaggcatcactgcagtgcattttgtgcaggcattgagagacctcttgagagagccaatgacgacggagagcccagcggcacggcgggaaaaccgattctcgaagtgattaccggcaatcagcttctgaatattgtcatcgttgtaacccggtattttggaggtacactgctcggaaccgggggactcgtgagggcatatacgaaggctgcccaggaagccgtggaggacgcagggatcgtgaccatgggtcttgggcgcaggttcaggaccgggtgtgattattcagctgcaggaaagatccagtatttccttgagaccgaagacattccaatcataaaaacggattacacagaaaaggtaactttggagtacttggtaccggaagccagatgcggacagattgagaagaagcttaatgacctgtcaggcggcatggcagagacacaagacacaggcaccgaatatacggtgacagataaaaagaaactttaaaacaatgaatcattgtggccaatgaaaagaagtgaaaaagagccgcgggtgtttgcccgcggctcaatatttattttacagacatcttattgtattctgtttacagcgctgatcaatgcgagaacagaagccgtaatgatatcctcatggattcccgcaccccataccacagtgccgtttggctgctgaatggctacataagagcaagcctttgaattagaacctacgtttagtgcgtgttcctggtagctgacaatagagtaatccagatcactgtgacgctgaagcgcgttgctcactgcatccagacgtccatttcccctgccgtggtaaagtttatccacaccggatttttcaagtgagatttcggcctcaatacccccgtctttctggataaagtgacattcttttaaagcgataggggatgatatgtttacatacactgtcttaaatacatccagaatatctttcggaaccagttccctgtgctgcttgtcggatacgtctttgaccgtatagcccacgtcctccctcatcttgcccgggatatggaaaccaaagttttcttccagcacatagccgataccgccttttcctgactggctgttgatgcggatcacatcgctttcgtattccctgccgatatctttcgggtcgatcggaagataaggaacagaccagtaatccggatggtggtcgtcgatccagtgcattcctttggcgatggcgtcctgatgagagcctgagaatgctgcgaataccagttttccggaatagggctggcgctcatagacattcatgcgggtcaggcactcataattttttgtaagctcaggaaggttggaaaagtccaggttagggtccacgccgtgagagtacatattgagagcgacggttacaatatcgacatttccggtcctctcaccatttccaaacagcgttccctccacccggtccgctcctgccaggagggcaagttccgtatccgccacaccgcatccgcggtcattgtgagggtgaatggacagtactacactgtcacggtattttatgtgtttgctcatatattcaatctggctggcgtatacgtgcggcatggaaagctgaacggtgaccggaagatttatgataaccttccagtccggagacggcttccagatatccaggaccgcattgcacacttccaatgcatattctacttcggttccggtgaaactctccggagagtattcgaactggaagttcccttctgtctcgtctgccagctttttcaggagtttggcgccgtctgtggcaatttttaaaatctcttccttggattttttgaaaacctgttccctctgggcaagagaagtagaattatatacgtgaacgatcgcacgcttcgctccttttaaagcttcaaaggtgcgtttgataatatgttcccgggcctgtgtcagcacctggatcgtgacgtcatcagggatcaggtcctgttcgatcagggtgcgcaggaaagtatattctgtctcggatgcggcggggaatcctacctcgatctccttgaatccgacctttaccaggtatttgaaaaactctactttttcatccaggctcatcgggatgatcagtgcctggtttccatccctaagatccacgctgcaccagtccggagcttttgttatgtactcttttctggcccagtcaagacactcttttggaggcataaagtattggcgtttatatttttctgaattcatagatattaaatctcctttcattattgagaataaaaataagactgcactcgtgcgatacggcgaaaaaaaaccttcgtctccgtccatttctggatagagacgaagggtcatagacactccgtggtaccactctaattcacgccataaccgcgtgcactcactaccgatacgagttgaaacaactgatatcttcccaatataacggttggaaccggcgatgcctactagctgttcagcatgctgctcagaggcgagttcacatataccgggcagccgcttttcaccagccagcggctctctgaatgccttctatatcctactattcctcatcaaagcatttggattattaataatgataatctaccacacttcattctatgtgtcaatggcagaattattcatgtaggtatctatttcgtccttcttttccggggacaggcagcggtagtagtggagcagtttttcttctttggtagagatgttgccgacaaggtaatcaatagaaacgttcagataatcacagagaatgaccagattctccagagttggctgcttttggccttttctccagtatccgatcagactgtcagacagacctgtgtctttataaatacgatagttggaaatatcatggctgtccagatattcatttaaattttctgcaaacttcatgtattttccctctctggcgtgtaacaaatttactcgtctattgtagcatagatgaaatttagtgtaaacgaagttgtaacgaaaatactgtggaaaattgtaccgttttcttgactatctctacgtatagagatataatttatgtaagtttcttacagtcggatgagggaaaggagaggctaatgataaagtcgtataaggaatttgaaaaatgggtaaagattgagatgatccgtcaggaattgacacagaggaagcttgcggagaaaatggggatcgcctatccgaggatctcagaagctctgcatggaagaaagacggggcttgcatttataatcccgctgattcaggagttgggaggcaatatggaagagtttgaagaatttcttgaaataaatcaaatcggacgttgagttttttcctggttgtattataatcaacttaaaaaagacaggggactgagatgggatttttagacagattcaaagttcatacaaccagagaatacgaagaagggaaagtgagagtcttccggcttcacgaagaggcagaaagcctgtcctatgtggagggaatctataaagaaaacggccggtttctgatgtctgtatccttcgtaaaaggacagcatgagacaggaaaagaggctcagctgcttgactgcaacggtctttttgcggcagctgtccagatcgaagagatccgcctgggttccggggaggaccctaatgaggcatcagaagcgggggaagagggtatcattgtatttgaccttgtcgagggaacacagcaatggcaggaaaagggccggtatttaaagggctgacaaatagagttgtttctttttgatgaagtgctataattaagtagctgaagtcattaacttttggaggtgcagtatggcacttgaaaataaatcaggaattgataattctgctgatcttgcccgtgaagtctatatgaaaggcattgattacagctactgctatgaaggatatacaacttttaaagccgaagaactgtagatgataaggttccggcactgaaaaacacagccaaaagagtttttaaggttccgatggctgtgcttttttatacaaaattttatttctgtgcctgtttcagggcatttttgatggactgtttcaagatggtgttggtatactggctttcatcattaaactggatgtcgtccacagattttacttttggaagctgtttattgatctcacccaaagccggttcgatcagagggtacatggtttttacacttttatctaaatgctttaaagcaacatgattgactttgttgtccttaacagtgacttccacttccagctcattttctcccagtgtgagaggagaggaatataccccttctatgtactccatagtctccgtgcttttcttatgttccttggatggagcaaacataaaaatcaaaagcaggataagcaagattccaagcaagacaaagatgccggtgtagattagttctttcgccttaaatacgacgattttcgtttttgctgacatagggtcctcctaaaaagattctattatagtatatggcccggacaggcagaatagaactgtacggaaaaaattttttccatgtagagcggccggtggttttcatgtataatagaagccgaaaaagaaaatgacatgacaggaggaagccgatggcattacagtgtgtcctgggcgcaggccgcacaggaaaaacggattatatatatgaacagatgataaaagagtctatggagaatcgggatgaaaatttcttttttctcgtcccggaccagtcgacgctgaatgcccagcgggagctgatcaccaggcatccgaaccacgggactatgaacatcgacgtggttggattctaccgtctctcttacagagtgtttgaggagctttcctatattcccaaagaactgctcaatgacgagggaaaatccatggtcataagaaaggtcatgggggagtgccgaaaggatcttctcgtgttcggctccggtatggaaaagcagggctttatcgatgagatgaagtctttctttgcggaaacctatcagtatgatgtatccctggaaaagcttaaggaggctgtggagtcttttgagaacagggacagcctgacattgaagatgaaagatatcgtcctggtcctggaaaagtttgaagagtacatgaaggaccgttatctggtatcggaacagctgttggacgtactggctcaaaagatcacggaatccgaaaagctaaaaggtgccacgatctatattgacgggtttaccggatttacacccatacaaaataaggtactcaagaaactgctgccgtatgccaaaaaaatcgtggcggcgtttaccattgacgagaaacgtgccggagggccatacagggattatgagctgtttgccatgcccaaaaaagaaatttcccaattaaaagagatagcggtaaggcagggagtccctatattgccggatgtgatcctgcacccgaatactgcgggatcggaggaactgcgccatctggagcagaacctgtttcggtatccttttcatgtgtacaggggtgagacaaaggacatcaaagtctgctgtcttaaaaatccaaaggaggagagccggtacatactgggccgtatcgaacatctggtcaggaaggaaggataccggtacaaagatctggtcgtgctgaccggagacatagagacttatcagccggaacttgaaaaatgctttgaggattccggcatcccctattttattgacgggaacagagcgctcaggaataatccatgcgtggagaccattctttctgcgctgaaaatgatccagatggatttttcttatgatatggtattccggtatttaaaatcagggttttctgcccttgagccggaggagactgatctccttgagaattttgtgatcgcttccggcatccggggatatgcccggtggaacaggccttttaaaagccgggcgtttacgaaggaagagatgaaacagatcaaccaatccagagaaacatttatgagagagaccggtccgttcaaggaagggatcaagaagcgcggaatcactgttttggagagacttacgcaccttcacgggttctttctcactctggatatccagggacagatggagagaaaaaaagaggaatttgaagcggccggagccctggctatggccaaaacctacgatcagatctacggagaagttttaaacatcatggaccagatggcggagattctcggagaggaagcgctttcttttgatgaattttgtgcggtcttggagaccgggctctcagagatgacggtgggtgtgattccgccgggactggatcaggtgatcgtcggagatatcgagcggacgagggtggaaggcgttaaagtcctgttctttgccggcatcaatgagggagtagtgccgaaaccgtcgaagggcggaggcctcgtgacggattctcagagagaagaacttttaaaagccgggatttcccttgcccccggggcggcaaaccaggcatatatggagcagtactatttgtatctggccatggcaaagccgaatgaaaagctgtatctgacttatgcttctatgaattcctccggggagagcaaagccccttcttatctgatcggaaggatcgaaaagctgtttccagggctgaaaagagaccgcgatttggaagagacagccgtttattcggtcagcgaggcaaaagaacggtttgttgaaaaacttcaggaactcggtgaggaaaagccggatcaggagatggccgcattatatgaagtcttaaatgaactgaagctggcttccttgtatctggatgcatatttctacaacaatgaggaaaagaacctggacagacatctgacaacgcttctctacggtaaggaactggaaaacagcgtgacccgtgtagaaaagttttcaggctgtgcctttgcccattttcttcagtacggactgcggcttcgggaacggctggtacatgagatcctgcctatggatatgggacaggtatttcaccggaccctgcagtttgtcgggcaggaaggaagctgggactgggaagatgaccgggaacgggaccaatttgtggattccatggtagagcgtgctttggatgaagatccggataagaaggagatttttgagagcagcagccggaatcaatatacaaaggagcggatcaagaggatggcaaaacgggctgtctgggccgtggaacagcagataaaaaggggagaattcaccccgtatgaatatgaactgggattttcagcggaagacggcctctcctgtgcaaatctttccctgaaggatgggacgaagatgaagtttaccggggtgatcgaccgggtggactgctatgaggatgaggaaaatctttatttaaagatcattgattataaatccggcaatatgcagtttgattttactaaaatcttaaatggtctgcaggtacagctggtcgtttatatgaatgccattttagaactggaagggaaaaagcatccggaaaagcggatgatcccggcaggcatgttttattttcacgtggacgatccggtcatagcaccgaaaacagacggggagcctgagatggaagttctcaaaaatcttcagctcaggggagttgtcaatgaagacttcggacttgtggagcatctggagcaggaggatgagtacgggattgtaacccttccggtcacaaggacgaaaacagggtacaaaaaagggtccgctctgctctctacaaatgaatttaaaaatctgggccagaaggtggaagaaaaaatgaagcagctcggagaggctatgatggacggggacatttccatccgtccgtatgaatatcagtcaatgccgtgcgattactgtgcattcaaaagtatatgtgcgtatgagccaaagctgacgaaattcaggaaacttgagaagatcggcctcactgaggcaaagcagctattagcagagggaaagggggcagacgatgccttggactgaagaacagcagcaggtcatagcggagagagactgcagccttttggtgtctgccgcggcaggctccggaaagacggctgtgcttgtggaacggatcatcgaaaagatatcgtcaaaagaggaaccggtggatgtggaccggctgttggtggtgacctacactcacgcggcggccaatgaaatgaaggagaggatccgcagagccatagaaaagaaagtggaggaggacccggcaaatgaacatctcatccggcagctctccctgatccacaaggcacagatcacgacgatccacagcttttgtctcaatcttatcagagattactactacaaactcgatctggatccgaattttgcaatcggagaccaggggcagatggaccttatgaagctggaagtgctggacgatgttctggaggaggcatacaccgaacagagtgatgctttcgtggaattcattgaaagctacatcccgggaaaaaacgatgagcgcatcagagactacgtcctcgggctctatgagagttccaggagtcatatcgatccgctgggctggctttcacatgcaagacagggatttcagattcgcacgaagaaagaacttcaccgggcagtctggatgaaggagatcctgaaagatgcgaaggcggtggcggaatccgcctgttctatgatgaggaaggcaaaagaggcggcgtctgagacgcggggaccgtatttttacctgccgaccctcaaggcagatctggaagccatggaaaagatccgcagcgcacagacatataaggacttcggagaactgtttttgaccttcacaaagccgcgtctaaacggaagaaagaaaaaggacgatatcattgacaaagaccttcaggagtactgcaaggatttgagaaaaaaggcatatgacctgatcgactccatcagaagcagctatttttacaagccggaaagcgagatcctccggcagatccgcagagtgcggcagcctatggaaggattcatcggcctgacagagaagttttatcaccgcttcatggagcgcaaaaagctggacaaccttttagatttcagcgatctggaacatctggcgctggaacttttaaccgagggcttttcggaggacgggactccaatcgtcagcgagatcgccaaagaaaaggcagaatatttccatgagatctatatcgatgagtatcaggacagtaactttctccaggatgcgattttaaggagtgtgtccggacagagcctgggagaacacaatatttttatggtgggggatgtcaaacagagcatttacagttttcgtcttgcgaggccggagctgttcatagagaaatatcacggatttaaaaaggacgggaaaaattcaaagctcatcgaactgagaaataatttccgcagccgcagggaagtgctttttacagtcaacgatattttttatcagatcatgcacgcatcccttgggaatatcgaatatacaaaggatgtggctctggtaccaagtttcccctataaggagacaaacggtgcaggcggaaatgcggaacttctgttagtcagcagagattggaacgatgcctctgaggaggacaaagacgtgctggaggccagaatgattgcagaccggatacggaagatggtggacgggcctgaacctcagatggtgctggattatgatgaggaaggcaatgaagtttaccggaaggcagaatacagagatattgtcattctcctgaggtctgtgaaaggaaatgccgagaagatccaggaggtgttaatggatgccggcatcccggtcgtatcaagcagccagagcggatattttgacacggtagaagttcgcactgtcctaagccttctgactgtggtggataatctgtatgcagacatcgagatggctgcttttctccggtctcccatgatcggcatgacgggggaggacttggcgaaactgaaacttggcggaaagaaaaagtatatgtatgactgccttagtgagacagaaggaaaagatgagaaagtggacactgcactgtcggtgctaaaaaggctaagggaagcgaaaacctttctgtcccttcacgaactgctctggctggcatttgaccttacgggatattatcattatgtcggggctatgcctcagggtgcgaaacgccagggaaatcttctgatgctggcagagcaggcgaaaacctatgaggccagccgctataaaggggtattccattttatccggtatatggaacagtgcagagaatatcaaatggatttcggtgaggcaaatacactgggcggaaatgaaaatctggttacgattacaagtatccataagagcaagggactggaatatccgatcgtttttcttgccaaaacacataaaaaatttaatttaagagatacgagcgggagccttttgtttcatccggattattttataggaccggaccttgtgaatatcaggcagagaacaaaggagcggactatcatgaagggtatggtctcaagacagctggtgaaggattcgcttggggaagaactgcgcgttttatatgtggcactcacaagggcgaaagaaaaacttatcatgacgggagtacagggaaaccgccatcagcctggcagcaaagggacggtctcctatgtggatctgctgagcgccaggtcttatctggagtggcttctcatggctgccggaaatatggaggaaagtccgtttgagatccgttttctctcggaggaggatgtagcgctctcaagcgcagaggaagtttttacatcttacagagacagggggttattaacggatgagctggaatccatggcagggtcaaaagaggcacaggacatgagagaggcctttgcataccggtatccgtatgacaaagaaagggacggcaggcttaaatattctgtctcagagatcaaaagaatgtctcaggcggcagaacctgaggagtcatacaagccggaaccgcaaaaagagccgctgtatccaaagtttttgggggagaagaaagaagcttctccggcctccagaggcaccgcagtccacaaagtactggaacttatggatttttctttggactatacaccgaagcttttggaagaacaaatcagtcggtggagcagtcaaggaaagattgagaaagggatggaaaagctgattccgcgggaagatatcctggcttttcttaactcagatctgggactgcggatcaagaaagctgcaggacgaaaagaacagtacaaggaagctcagtttgtcatgggaataaagttcagtgagatggaaccggaagctaaaagccgggattatgtggtcgtccaggggatcatcgacctgtattttgaagaagaaggggaacttgtcctggtggattataagacagaccgcataagtcccggggaagaggaggtccttgtctcaaggtacaggccgcagcttcagtactacaaaaaagcgctggaacagatggagaaaaaaaaggtaaaagaatgttacatttactcggttcctcttaggaaagccatcagtttataattatttaacatcctatcagataaatttaagaaactgggcatagggaaatcacaattctctgctatcataaaacatggaaagcaaagaacgaatcagacatgaagcaaaggagtgatgaccatgtcagagaaagcaacgctttcagtagaagaattgatgaaaaagagtttaacatttgccctggccgcaacactgctggcaggcacatcaaacatctcaaaagtgaaggataagattaaagtaagtgagaacgagacaggacatattgtcatagaacagatgaatgactaggcctttctttggttatcctatatatgaccggcaaaagccgggggataagagaaaggagtacatgatgtccaaagaaaaagattttatagaaaagtcatttgaagagatgacagaagatgagcggttaaagtacgagatcgctgtggaacttggactggctgacaaagtaaaggaggagggctggaaagctctttctgccagcgagaccggaaggatcggcggcctgatgaccaagaggaaaaaacaaaaagcacaggaagcagaagattaagaaaaaatataataccgtctgtatttgatctgatatggggataaaatacaggcggtatttttaaaatttaatagaaatacttgaaaatacttaaaaaaacgcttataattgcttgagtacaggaaaggaggaccaaatgtaccagcaagaacggctttcaaaaatcatgaagcttctagaagaaaaagaagtactttccagccaggaaatcatggaggcatttcgaatttccagggatactgcaaggagagatattgtaaaattgtcagaaaagggcgcggtgatcaggacgcatggaggaattgcgctgccgcaaatcaataatatcattgaggaatataaaggaaggcagcagctgaatgtagcctcaaaaaaaaggatcggaaaagcggcagcggagcttataaagcaaggacaggtgtgcttttttgacgtctccaccactgtctgttttctgtgtgcaaaccttataaaaccttctgtcatttatacaaattctatggataatctaagcatacttgtggaaaaggaaaatatcgaagtctgtgcggtgggaggaaacattaaccgcaaaaaccgtttttcctatggaggagaggccagagaacagctgatgaaaatccgttttgatgcagcgtttttgggagccgcagccatttctgaagacggtatttatttcgaggaaaaagaagatgcagatgtaaaacggatcgcggcatccagagcagagagagtcattgttctggcagacagcacaaaatttcagaaaaagagcagatatcaggcattacctctaaaaaagattgacattttaattacggatagagatccggattctttttggagacaaaggcttttggagaatgaaacaagaatcatcaaagcaggaaaatagcagagaaaggaaagcatatgggaaaatataaagcagtattcagtgacattgacggaactttactagattcaaaacacaccatttcgccggctacaaaacaaaaaatccaggagattgacagggaaggaattccttttatcttagtttcagccagaatgccgaagggaatgattggaatccgggatgaacttggcatccggaggccgatagtttgctacagcggagcactggttgtggatgaaaaaggagagacaatgtttggcaggaacattgagtctcatatggcggaaatggtttacagaagtattcaaaaagaaaatatgcatatttcctttaacctttacagcggtgaccggtggattgtgcccgaccagtgtgatccgtgggtcagacaggagagcgttataacgggagtgtatccggaaacaggagattttaccgacctggcagtatttcagaatgttcataaaatcctctgtatgggagagccggaaaagatcctttgcctggaaacaatgctgaaggaacaatttcctaaactcagggcatatcggtctaaagatacatatttagagattatgtctatacaggcatcaaaatccagtgcagtttctcttctggacgagtatttcggcatttccagacaggaaattatagcttttggtgacggatacaacgatatagatatgcttctctatgcaggactgggagctgccatgggaaatgcgtcagaggaggtcagaaattcggcggatatcgtagcagataccaatgaccaggaggggctgaagaaagttctggacgaatatttttaaaatatacaatgaatggggaaaactgttttttcgttctgttatatgatataattttctaagatatattaatcgtctacgggaatgatgacaggacagtgacaaagcagtaaggagagaaatatgcaccaggaaaaacagaaaaaatcagtccgggatacaagaaaaagactggatgccgccagtatacttatattgatcggaattattgttctgctctatgctaaagttttttattcctatgaaaaaacttatggaaaaaataaaacaagaacgtttggagctacctacatgacaatgaacaataacttttatccggtgctgaataacgagatacgttctgcagtggaaaagaaaggcgaccgtctgatgactctggatcctgcactggatcagaaaaagcagacggaacagatctactatctgattcagcagaaggtggacgccatcttcatcaacccggtggactggaaagggatcagaggggctttaagggctgcaaagaaggcagagattccggttatcgttgtggatacacctgtctatgatgaggatctggtttcctgtaccgttgtttcagataattataatgcaggtgttttatgtgccaaagatctgatgaaacgcagaaaaagtgcgagaattcttcttttggaacataagaaagcaaaatcggctcaggaccgcatccggggatttttggacaccatacatgggaggcaggaatatcaggttgtggcgcgggcagatacagaggggcagacggagagaactcttcccaaagtgaatcaagtgataaaaaatggaaagatgtttgatgttgttatggcgctgaatgatccgactgccatcggggctttggcggctctggatcagaaggggatccgggagcaggtattggtctatggaattgacggctctccggacgggaaaggactgatcaaggaaaatatgatgacagctacatctgcacagtctccaaaacaaatagggaaagaggcaatctgttcagcatatcggcttctggacaggaaaaaagtatcaaaaaaaattatcattccggtccaaatcattacttataaaaatattaacagattcgatgtgaataactggcagtagggaagcgtcatggatagaaaaaataaaaacttatattatctaaaagtatttatgagctctgtgaatttcataattctggtgtttttgtctgccattgtgcttaagacaacggtaaatattaaggatcagagtatggcgagaaattttctggagaatatcccgcatattccaagggagcctgttcagtcaacgattattgtattcatagcgtttttttctttgctggtgatcattgaggcaagaaaaaaaatctatacaaaacattggctaagtgtgctggtttatctgctggagatctttctttgcctgacgatcatacagtatgtgtatatcagctataatggaattattttgctggtgatcgcagatatcgtaacttcaatcaaggagaaatataaccgcctgacttttcttgtggttatgagtgttatttatatttttgcagattacaatctggtatcagggcagataccgatgatatccctgcaggaatatctggatatttatccttcgggcatatccacatttctgatggggataaagaatgtacttgcggctgtaaatattattgcgtttgttatgtatatgatcattttgatgcagaatcaaatgaaggaaaatgcaagaatcgaactgttgaacctgcagcttcggacagcgaatgagaaattaaaagatatgaatgcacagctgaaggattatgccgtgatgcaggaaaaaatgggggaagcaaaagaaagaaaccgtgtggcaagggaaatccacgatactctggggcatacgatgacggggctttctgcaggtattgatgcctgcattgctatgatcgatcattctgtggaacagacaaaaaaacagctttctgtgatttctgaagttgccagacagggaattaaagatatccggcgttctgtaaataagttaagaccggatgccctggagcatctgaccctggaggatgcactgtttaagatgattcaggatacgatggcggtgtccaacgtaaatatttcactgatttcctccgtagagaaattaaagtttaacagtgatgaagaagatattatttacagagttgtacaggagggaattacaaatgcggtcagacacggagcagcaacaaagatcagtatttacataacaaaaaaagaaaaatggctgactcttttaatccaggataatggaaaagggtgtgaaaagattgaaaccgggtttggactgatccatattgaagagcggatcggcttgcttcatggtaccgttgcctacgatggcagcgatggttttacaattacggcaaaaataccgatcaggtggggtgagaattatgattaaagtgttgattgcagatgatcaggagctgatcagacagagtttggagattgtgttaagtacaaaagaagggattgaggtgacgggaactgcaaaagacggcagagaagtgatccgctgcattcggaaagaaaaaccggatgttattctgatggacgtgcggatgccggaaatggatggggtacagtgcacagaaataattaaggaaaattatccccagatcaaaattattattctgaccacgtttgatgatgatgagttcgtattcagtgcactgaaacacggtgccagcggatatctgctgaaagggatctccatggatgatctggaggaggcgataaaaacagtggttcagggaggctccatgatcaatccggatgtggcaactaaggttgtggaattgttttcaaaaatggcacagagcaattttgatatgatgatcgatgccaaaaatgtagaggatcttaacgagacggaaaggaaagttacccatctggttggatgcggaatgtccaataaagaaatttcagggaaattaagtctctcggagggaactatacggaattacctgagcagtattttaaataaactggatttgagagaccgcacacagcttgcaatctgggaggtacaaaatgggatcggaaggaaattccaaagagaagataatgaatagaacagtaaagtggtggaagagaattgttctggcaggactgatcctgagcatttcttcaatctgcattttttcttaccagggggaagatgatgtagttctcacctttggaatgtttgcaggcagccagtgggatgtgcctaatgatgactgctatcagatcatcgatgatacgatcaaacgttttgaaaaagaacatccgggggtaagagttcaatatgtcagtggaattttaaaagaagattattcagaatggatttctgaaagagtgttggagggaaatactccagacgtgtttatggtgcttccggaagacgttgcaactttttcttccacaggagttctggaaaaactggacagtcatatgaaagccgaccagactttccatcagagtgattattatcaaagtccgtatgccgcaggaaggtatgaggaatcccagtatgccctgccgtatgaaagtgtcccaacgctcatgttcgtcaataaaacgctgttaaataaagaggggatccggattcctgataataactggacctgggatgaattttataatatttgcaaaagactgacgaaagacacagatggagacggcaagattgaccagtttggagtttatgcttacagttggaagaattttatggataccaatggatgtaaattatttaatgaggcaggaacagaaagttatcttacagaggagcacgtaaaagaggcgattttttttgccaaaaagattggagatttatcaggttaccaaaaggcatcctccaatgactttgataccggaaaagtagcattccggccaatgagttttgcagaataccgaacttataagccgtatccatggagaatcaataaatattttaattttgactgggattgcatcaaactgccggcaggacctcagggaaacaatgtatccaatgtggacagcctgatgatgggaattgggtcgggaacaaggcatgaacagctttcctgggaactattaaaaatgttcacctatgatcagaaaacacagatggaaatctttaaaaactctcagggagtgtctgccttaaagaaagtaaccaattctaaagaaagccagaaaattttgaaaaaagctacggacgatgatactgtagtaaagcgggaacttttgaatgaagtgatgaatcaggctgtgcagaaatcaaaattcagaaattattttactgcagagaaatatatcagcaatgagctggaacggattcttagctcgacagaggatttggatgatagtttgttgacgctgaaaaaagaagtagaacagaaatttctgcagtaaaaacagaaaaatcggcacgtgtgacaattgtcatacggatttgtgacatttgtagattgttattcatgacaatttacagatgtcctttttttacccaattggtaaaatgtgcttgttaataagagatacaaaaagaagaaaggagtagaggatgaaatacgtagtattagtcagtcatggaacatttgcaccaggacttcaaagtgttctttctatgctggccggaggggagcgggaggatgtcttaagtatcggtctcattgacggcatggatgcagatgagttcgctcaaaaattcaggttgatgattcagccgttcggagaggatgatgaagtgatcctgcttggcgacctgatcggaggatcacctctcaccaatgcggtaaatgaattatccgaggcagggcttttaaagaataccatcgtcttcggaggaatgaaccttggtatggcattgactgcggtaatgatgaaagacgatatggaaacagacatgctgaaagaaaatctgttgtcagaagccaaaaatgcaattaaagaatttgaaattgaagagagtgaagaggaagacgatatctaaggaggagttttattatgtcagtatcatttgtgagggtagatgaccggatgattcacggacagacggttacaagatgggcactggaatatccgtgcgacggattgatagcggtcaatgacaaagccgcaaatacacccgcattaaaagcagcttataaaagtgcggcgggaaagaaaactttcatttggacatatgaggactggaaaaagaaatgccagaaagttttagacagcaaagatcagtatttcctcattacaaaagatccgattcagatgaaaagtattcttgtggatgacggatttgtacctagtgatgtgaaaaaagtgatcatcggtccgtgtaatgaccgggaaggtgccacgaagctgggaaataaccagtccattacacaggaagaagcagaagcgctggaagcaatttatcaaaaagggtatgagattgaatttgccctgatcaaagaagcatccataggaacctggaaaaaatttagaggtcagtttggatttgagtaaaatcagagaggagaaaaaacatgacgattaattggatacaagcagtcattttaggtatttttgcctgcttatcaagtatgcctggtatgggaggtacttccatcggtaactatactctggggcgtccgttagtagcaggtcttgtatgcggaattgtattgggagatgttcaggcaggagttctggtcggtgccgcaatgcaggttgtttatatcgcactggtcacaccggggggaacagtatccgcagatgtccgtgccgtatcttacataggagtgcctctggcaatgctcgcactgaattcttatgggctggaccctgcatcagcaaaagggatcgccatggcaacatcattcggagctatggtaggaactcttggaactgtattattttacggaacagcgaccattaacctggtgtggcagcatatgggatggaaagctgtagaaaaaggagaatttaaaaagttatacatagtagatatggtgcttccatggatttcacatattatctgcagttttatcccggcagtgatcatgtgtaagctcggagtaccggtagttgaatcaattaaaacagcacttccgatggacggaattgcaatgaaaaccttgtttacagtaggaagtatgctgccttgtgtcggaattgccattttgttaaaacaggtcgtagataaagcagttgattttgttccgtttttctttggatttactctggcagcaggaatgggattaaaccttgtatcagtaaccgtagtggcgggaatgtttgcaattatttactacaacataaaaatggttgggatccgtgcaaaaaaggcggcagccgccggcggttccatcgatgacgatgaggaggagatataatatggcagcggaaaaaaagctttctaaaaaagcattaaaaaaatcatttcgtaactggtattatggacacttaacctgcttttcgcaggagcacatgcagacgtttggttatttatgtgcaatgcttccgctggtggaagaattatatgatacaaaagaagaacagaaagaggctatggaaacatacacggcattctttaatacagaaccgcaggtaggatccgttatcgtcggagttacggcaggtttggaagaggcaaaagccaatggaaaccaggatgtggatgcagaaaccatcaatggtatccgtgcaggtttgatgggacctttggcagggatcggagattctctggtcgtaggtactttaattccgatccttcttggaattgcccttggattatccagcggcggatctgtcgtgggaccaatcttctatatcgttgtatggaatctgttaattacctttggcatgagatttctttactttaagggatatgaattgggtggaaaagccgtcgatatcctggtaggtgagcaggcgaccgcgatccgcgaatcaattgtaatgcttggaactatggttgttggagccgtagcagctacctgggtaagtgtaaaaacatcgttccatctggtaaatgatgccggaaaagaatttttgaatcttcagaatcagcttgattccgtatatcccaatgtcctgacagcagcatttgttattttctgctggtggctcatgtccaaaaagagagtgtctccggttgtgacaatgctgattttagttgtcgtagcatttgcaggagtagtggttggattctttaatcctggattgaaatattagaaggagagtctattatgacaccacagacaaaacagcagaaaataaaagaaattgaataccagacaaggatgttaaaaaacttaaagaactggatacggaatttattgattttctcttcaattggagttgcagttgcctactgggcactgaaaatccaggaaggaccattgtttacagcagtcggtgtggtcagcgttatttttattgttctcagtgttgttttaagcggcgtcataggatttgccttcaaaaacggaaagagcaatgttgataaaatcatcagacaagtgtaatagtgaatctcttgcaggaaaggacagcgcagaatgataaacggctgtcctttttgttttaaacccgaataaagtattgagaaaggagacaggttatgaatcataaaaaatccagagtcctggcagcggcaatatccagtttgctatctttcggcatgatattacagacagcagtccccccgcaggtttatgcgtcagaaggaatacgaagggaaagcagtcagaaagtgtctgactggacatttaaagcagcagacaataatgatcaaacagcggtaacagaagtagtgagaagcgatgcgtaccttagcggactggaaattaaaggaggaagtctggacaagccattttcccgggaattcagtagttacagtgtggtggtaggccacaagacagacagtcttactataattcctaaaattgacggaaacgcagcagttactgtgaacggaaaggcagcaggttccggacaggctgtgacagtcaatgtgaaaacaggttcctatgtgtttaatatcgttgtcaagggcgctaatggaaaaacagagactacggcagtcaatgttttgagaaattctgacccggatgatgtctacagtgtgccgtaccgttctcaatatcatttttcacctcagagagcatggtgcaatgatccaaatggcatggtttattataaaggcgaataccatttgttttaccagtactatcctgacgatatgatctgggggccaatgcactggggccatgctgtatcaaaggatctggttcactgggaggaacttcctatagccttatatccggaatcagacggaggagctatgttttccggatgctgtgttgtagacaaggataacaccacaggattttttggacagggaaaagagggcctggtagccatttatacgcaggacaatggagataaggggcaggaacagtgtctggcatacagtaaagacaagggcagaacctggacaaaatatcaggggaatccggtacttaggtgggaggatgatcggcttttggataaagccttccgggatcctaaagtattctggcatgaagaatccggtcagtggatgatggttgtggcaggaggaccgctgcgtatctattcttcaaaaaacttaaaaagctggaaactggaaagtacctatggaaagaaaacaaatgaaggaatcgcggatcagccggctgacagcgcgaggatttatacagagtgcccggatctgtatccgcttaaggtagacaataccgatcagacaaaatgggtgctgagtgagggaggcagatattacagaatcggtgatttaaagcagcaaaatgaacactggacctttgtgccggattctgattatagcaatacaaatgacaatatcagtgatcctagcagttacaaaaatgatgatacttataaaatgaattttggacctcaatcctatgcggcacagacttacagcaatatgccggacagcaggacagttatgatcaactgggcaagtacctgggaaaacggatactgcaacaacgtaagcgaagtaaccgggcagtacggatttaatggcttttttaatctgcagaatgagttaacgctgaaacaaatcgacgggaaagtacgtttagtgcagaagcctgtaaaagagtatgaatcccttcggatgcaacaggcaaaaacggaacttaagaatgctgtaatcccggaaaaaacagattccagtgaaaatcttctctcaggattccagggcggggaatatgaaataattgcagaatttacaccgaagaccggaaccagagaagtcggatttaaactgcggaccggtaaaaatggaaagcaggagaccgttgtaaaatataatgtccaagatgagacgttgatcatcaacggagataaagccggagttcttccacaagggcagataaaaggagatataaagtcaaagatatcaaagagtgctgacggaaaaattaaacttcatatttttgtagatgattctattgtagaggtttatggaaatgagggagagaccgtgggaagccttgctgttttcccagatgcaaaaagtaccggggcagaagttttttcagagggcggacagacagaagctgatattaccatttatccgttaaaaagtatctggtcagataaaatgtctggaagtacagatccggcaaatgtatatttaaatacggaaacagcaagttcttccgtaaaactgggagaaacaacaactttaaattcgacggtcactcctcagaaagcggagcagaaagtttcctggtccattgcagggaacagcggaaaaaaggtttccatcgtaaaacaggatgccggcagtattaccctgaaaggagaaaagcagggaacggtcatcgttaaggcgaaaacttccaatgggattgccagaacgatggaaattcaggtagacggtgaggatgaaaaattaaacagcaacctgtccggatggcatcaggtaggaggacagtggacgcttgacgccaatggctataattcaaaccataaagataatggatttctgatttcttccacgaaaacaggctctgattatatttatgaagcagatgtcacctatcaggagggaaatgcgattggtcttttcttccgtggacaaagtccggattccgacaaaggatatgtggttaacattgacgatcctgagcataaaggtaacggaagcacaaggatctttaccttcggaggcggaaccggagatatcggtagccgtgttaagtatacactgacccctggggcaacataccatctgaagctggaggtaagagggaataaattcaagttttatattaatgattctctgaagctgaatgtaacagaccggaatattaaaaagaattatgcagaaggggattatgtggggctttatgctttcagtggaaccggagagtctgataaaaatattcaggcttcctatcaaaacattaaagtgacgccgctggaagtaaggaaaccttctgttcgggaaaagatggaactgtacagcggacagagcattcagcttgccgcagatttaggcgaggatgattatgcagctgcctactatgaatcttctgatccttctgtggcatcagttgacgatgatgggaaggttacagcaaaacggtcagggactgcagaacttacaacaaaagtaacctattatggccgaaccgtatatctgaaaacaaaaatcacagtgaaaacaccgtatgtcaacatcacttctgctccgtcatcgatgtatgagggacagagtgccaacatctcagcaaaggcaacaggagtttcgggaaatattgtatggaaggtagataatgcgtcctgtgcatccatttcttcttctggtaaactgacagctaaaaaggcaggaaaagtttatattactgcaaaagttggagtgtattcaacgaagaaaatgatagtcattaaaagaccatatattaaaattacttcctgtccatccagtgtatatacaggaaagagtgttcaactaaaggctcaggcagtgggtgtatcaggaaaagtagcatggagcgtcagccgccggtctttggcatccgtttctgcgtctggaaaactgtctgcaaaaaaagcaggaaagatcacagtaacagcaaaattaaaaaattacagcaaaacagtgaaggtgacgattaaaaaaccttacctgaaaatcacctcctatagaaagacagtgaaacgtagaaaaagttaccggtttagagcaaaagcctatggaacctccaagtccgtcaaatggtctctttcatcaaagagcagaaaatatgcttctatttcaaaaggcggaaagcttacgacaaaaagtagaaaagggactatcacggtttatataaagtcaggttgtgtaaggaaaaccttgaaagtgaaaattaaataataatatattgtattatttgcgtatcctatctgtagaaatggagattttcagatttttgtatgtttgaacaatttttatgatactatagtcacacttaaagatctgaagatagattcaggaggatatgattatggatagctttgctttaaaaggagacattatttatacgcctgaaccagggaagttccggagccacgaggattcttatctggtctgtggagacgggaaggtgaagggaaaatggagagaacttcctgaacgattttcagggatcagagttgaggattacagcggaaagcttatttttccggggctgtgtgatcttcatattcattcgccccagtattccttccgggggatcgggatggatatggagctgcttccctggctggaaacttatagttctgcagtaataggttgaaataaaagcaaatgttctgatgtattacttgtaccatacggaaccgtggctgtgctgaaaaaacgcaaatgatagaaaagccggcgcaaacgacaaaaaatatacttgaatttttcagataacaggattataatattttttggtaaggcagaggaatgctgtctgccatataatttcataaacaagtaaaactggagaaccgatgttatcggctgagaagagggtataacccgaagattcatggaacctgttagttagcactagcgtagggagttttcaatcgatagaacacagagatggagcttacgcttcatctttttttcgtttgtggctccgggaaacgaaaggagagttatgatgcgtgtcaatggaaacaaaagattcctcgagggcaggatcactctgaaggaatttcttctgaaagagggttacaggcttgagcacattgcggtggagagaaacggaaagatcgtcccaaaggctgagtatgaaactatcatgctgacagaggcggatacactggagatcgtcagtttcgtaggcggtggatgagatgctgacgagagaacgatttgaacaggaactggacagacgccagacgccgaaagtgagggaaaggctcagggaaggaaccgtggccgttgcgggtcttgggggtcttggctctaatatagccctgatgcttgcaagaacggggatcaggaagctgtttctggcagattttgaccgggtagatccatccaacctaaaccggcaggcatacaccatttcccagattggcatgaaaaaaacagaagccatgagtgaactgatccgccaggtcaacccgtggattgaactggggttttttgacggaagggtgacgcaggaaaatgcggcagagctgtttcggccatatccgattatctgcgaggcatttgactcgccaaaggcgaaagccgagctggtcaacggcgtattgtctcagctgcctgacaataccgttatttccggcagcgggatggccggatcttacagttcaaatctgataaaaacggcaaagaaaatgaaacggctttatgtgtgcggagacgggacacatgggatatcaacagaggaatcactgactgcggccagagtatcaatctgtgcgggacacgaggcgaacatggcgatacggctgattttaggagaagaagaggtataaagatgagtgatacattaaaaatcggaacaaaggaatttacatcaaggtttctgcttggaaccggaaagttcagcctggaaaagacggcggaggctgtaaatgcggccgaagcccagattgttactatggcgctcaggcgggtaaaggaggcaggttccagcaatattttagagtacataccggatacggtgacactgcttccaaacacctccggggcaagaaatgcccaggaggctgtgcgcattgcaaggcttgcaagagaagtgggatgcggtgattttatcaagatcgaagtgatacgggatacaaagtatctgatgcccgacaacgcagagacaatcaaagccacggagattctttcaagagagggtttcactgttcttccctatgtgagccccgatttgaatacggcaagggacctggaaagtgcaggcgccgccgcggtcatgcctctggcagcgcccatcggaagcaacaaaggactccttacgaaagattttatccaaatgctgattgatgataccgatcttccggtcattgtggatgccggaatcgggaagccgtccgaggcctgtgcagcaatggagatgggagccgatgccgtactggcaaatacggctgtagctacggcaggagatgtggtatccatggcaaaggcttttaaaatggcagttgacgcaggaagaaaggcataccttgccggactgggacgggtcctggaccatggaggagatgcctcatctccgctgacaggatttttggaggactagggcgatggagatattagatgaagtgttaaaggaatatgatgaatatgactacaatgtttacacaaaagacgatgtcatcacagctctttcaaaagaaacggtgagtgctgaggactacaaggctctgctctcaccggctgccatggattttctggagccaatggccaaaagagcaaaaaaggaaacaatgaagcatttcgggaatacggtctgtctgtttacaccgctttatattgccaattactgtgtcaatcactgtgtgtactgcggctttaactgtaccaataagatccaccgggcaaagctcaccatggaagagattgaacaggaatacaaagctatcgcagggacaggactgaaggaaatcctgattctcacaggtgaatctaaaaaagcgtcaagcgtagaatatatcgggaaggcagtagagctggcaaagaaatatttttccaccatcggcattgaagtctatccaatggatgtggatgaatacgaatatatccaccaaaaaggtgcggattttgtcagtgtctaccaggagacatataatacaaagacctatgatgaggttcacttaagcggtccgaaaaaagtattttcctatcgtctgaatgcccaggaaagagcgttaaaaggcggtatgaggggagtgggatgcggagccctgttggggcttgatgatttcagaaaagacgcatttgcttccggaattcatgcgtcccttcttcagaaaaaatatccccaggcggaagtttctttttctgtgcctcggctcagaccatataagaacaatgaaaccaacgatgcaaaagacgtccatgaaaagcagcttctgcaggtgatgctggcacaccgcattttcatgccgtttgcgggaattacgatttccacgagggaacgggccggattccgcgatcatgtggtcggcatggcagcgacgaaaatttccgcgggagtcagcacaggggtcggaggccatgaagaagaggaaaagggagacgcccagtttgtgatctcagatccgagaagtgtggatgaagtcgtaaacatgcttgaccgcagaggcatgcagggaatctatactgactacgtgagagtctagaaacggaggttgacatgaatcaggagtggatcgctgtcacggaccggaaactgtgcggcggtgattttttaaagacggtgcagacccttgcgggacaagggttaaagacgatcattctgcgggaaaaagatcttccagaagaagagtacggggtactggcagcccggtgtatggaaatatgcaggaaagctggggcttccctgactctccacagttattttagtgcggcccgcaggctgggagcagacaagatccatctgccgtaccctgtatttcgggaaaatgcagggaagattgaaaagcaccttcgtgtaagtacctctattcatgccccggaagaggcagtggaggcagaacggatgggtgcagagtttgtgattgccggacatatttttcagacggactgcaaaaagggcgttccgccaagggggcttgagtttttaagagaaactgtacgatccgtgtctatccctgtctatgccatcggaggaatcactccatataatataaaggatgttttaaagacaggagccgccggaggatgtatgatgtcgggtttcatgaagtcgcctaaaatcgttgacaagccatgagtgctggggcatacttgaaagagaaatatatcaagatggagggtacttatgaaaaagaaatactgcttttttgacatcgacggaacactgacggaccgctctaccaaccaggtagttccaagtgcgctggaggcacttgaaaagctggaggaaaacggacattttgtggcgatcgcaacaggaagagcccactataaagcggatctgtttataaaggccaacggttttaagaatatggtctgcaatggaggaaacgggtttgtcattgacaatcagttcgtggagaatattcctctggacagagaaggatgcattaaaatcattgaggagacagagaaactcggatatggatggtgtattgccgtagacgatacaaaagatgtctatatgaccgacgatttgtttttaagacaggtgggcaagagaaaagagccgacccgctatattattgatgacaccctggatatacataaggtcgaagatttctataaaatatatgtagcaattccgaaagaagaggaagaccgtctgacgacaaaagatctcatcggacatctgcggtttgaaccggagtacctgatgttccagccggacaataaaagagaggggatcataaaaatgatggagcacttaaatgggcctcttgaagatgtggttgtatttggagatgattataacgatctggatatgttcagccctgagtggttttccatcgccatggggaacggctgccaggacctgaaagataaggcagactacgtgacagacaccaatgtgaatgacggaatcaaaaaggcatgtgagcatttcggctggatttaaaaaggacagaagccttcttgacacaattccttaaatcattatagaatagtaagaccagaattttctggtcttcttttcatttcttaggaaagtccttgtcaggaatctatttggcagcaggaggaattatgagaattttaaaagtaatgaagaagggcatatcgaagatgctgaaggtccttctgagacgccttgtgattgtaggcgttatcattgtgctgcagatagcatggctgatctggatggcccaggtgatcggagagcgatctaagtttattgaatggggacttcagctggtcagcgttgcagtggtgatatatattgtaaataaagaagagaacccggcctataagctggcgtggaccattcccatcctgatcttcccggtattcggcggtcttttatatcttactctgggcaataaaaaaatggccagaaagctgaggctggaactggagcgttcccttggcgagacagattttttgctgtctcagagcgagagcgtcatgaataacttgagacagaggagtcctcaggcggcggcacaggcaaaatatatcgatatgtcaggaggctatccgatctatcagaattcgtcggcaaagtattacccgtccggcgagtccatgtttgaagagatgatcgaagacctgaaaaaggcaaagtattatattttcatggaattcttcattgtggaagaaggatatatgtggaatacgatcttagagatcctcaaagaacgggtggacgacggtgtggaagtccggtttatgtatgacgacgtaggctgtgtggacctgctcccgtataagtattataaagaactggaacgctgcggcatttcctgcgtggcatttaatccgattattcctctggtgtccaccgcatggaacaacagggaccatcgcaaagtagtggtcattgacgggcatacggcatataccggaggcctcaatctggcagatgagtatatcaaccggaaggaacgtttcggttattggaaagacgcgggattgaaagtcatcggagatgcggtgtggaactttaccgtgatgtttctccaggtctggaatgcgatccggaagaccgatgagggctacggcatgttcgtaccccacggccaccataagggacggtttgttgacgacggttttatccagccctacgcggataatcctctggatacggagacagtcggggagaatgtgtacctcaacatcatcaatgcggccacagattacgtatatatctatacgccgtatctgatcattgataatgaaatgatgacagcgctctgcctggcttccaaaagaggagtcgatgtgcggattgtcacaccgggaataccggataaaccgaccgtctttttgctgacacagtcatactatgcccagctggtggaggcaggggtaaaagtgtatcagtatactcccggattcatccatgcaaaatgttttgtcagtgatgacgtcattgctaccgtaggaacgatcaacatggattaccggagcctttacctgcattttgaaaacggagtctttatgtatcactgcctggcggtgacggaagtcaagatcgatatgctgaagacgtttaagcagtgtgagctgatcacaaaagatcactgtcagggcaatatggtgaagcggctgatgcagagtgtgctccgtgtcctggcgccgcttctttaaggagtaggacaaaatggacgagtttactagttaccagagttttgcacaggtttatgatgaatttatggatcagaccccttacagacagtggggagaaaatataagacagtatctgagaaaatacaaagttaaggacggagcagaggtcttggacctgggctgcggcaccggcaggatgacgaatctgctgaaaggctttggctaccggatgaccgggctggacatttctccggagatgcttgagattgctgccggttccggggattctgaaatcctctatatctgtcaggatatgagagaactagctcttctgcatcctgcggatgcggtcatatcgacctgtgacagcctgaattatatattagagccggaagatctgatacaggtatttgtgcgtgtgcgggagaaccttaaagaaaacggggtctttctgtttgacatgaacacgctttataaatatgaaacactgcttgctgaaaatacgtttgcggaagaccgggaggagtgcagttttatctggcagaatttctatgatccaaaagacggcatcaatgaatatgacctgacactctttatccgcagtgaatccgggctttatcataagtttgaggaaatgcattttcagaaggcatatggaacagaagagataaaagaggcactgcgtctggccggatttgaggtccgggaggttatggatgcagatactttaaaagagccggagacagagagtgaacggctgtattttatttcaacgataaatcatgaggtggacaaatgaaagattatattgtaagaggtacggcggcagacgagcaggttcgtttttttgctgcctatacgaaagatgttgtggaggaggccagacagaggcataatacaagcccggtggccacggctgccctgggccggcttctgaccgcaggtgccatgatggggagcatgtgcaagaatgaacaggatatgatcacgctccagataaagtgcagcggtccgatcggaggtcttacggtgactgccgattcaaaagcggatgtaaaaggatatgtggtacatccggacgtaatgctgccgccgagcaaagaaggcaagctggatgtcggaaaggccctggacttaggggtgctgacggtcattaaggatatcggcatgaaagaaccgtattcgggacagacccatcttgtatccggggagattgcagaggatctgacctactactttgccgcaagtgaacagataccgacttctgtggcgcttggtgttttgatgaataaggataataccgtccgccatgccgggggttttattattcagatgatgccgtatgcttctgaggaagtgatttcttcactggagaaaaagattgcagattttcagtctgttacttctcatctggatgaggggaaaactccggaagatatgatgaatgaattgctgggtgagttcggggtcaagttctatgagactgtgccgacgaagttttcatgcaactgttccaaagagcgggtggagaaagcggtcatcagtgtgggaaaagacgagattaatgatatgatcaaagatggaaaagatatagaagtaaactgtcatttctgtaatacacactatacattcagtgtagatgaactgaaacagatggtggaaaaaatcgaagcaggaagataatgaaaagccatgggagaccgtggcttttttgcttaaacatggtatacccacaaggcatcccatgtttcataccctgcgggtagacgtgcttcgcacaataaggtatgataaaaggaaaggagggcgaaagatgaagataaaaaaagcagttgtaatgttattgtcgttgtgtctgatcatttcgcagatcagcatggcaaaggctgcagaggcatatccaaatctggatgagaatattatcgtgaaaagttacagcggcggaaaatatgaagcaggggaagggtctaatgcagaagattgctatgcactttcatcggcagaaagaaatctggatcagaccattgtgatgccgtcagataaagtgatggtcctgcacaattcaggagagaaagattacacaaatctcagcgctgtattagaggaagacagcagcacaaattataacggtgatgtaaagctcatactttcttcaaaagagctgagcaggaacaaaacagtcagcattaccataaattttgcgaataaaaatatagcaccgtgtcttaacaggactgcggttttattaaaagaaggaaatgatgttgtcaaaagaattccattttcatatgatacagccgggtatagagatgaacacaatatttcagtgtctcagtggagcggaagctatgattatttttttggaatcgggacagtgaagaatatagggaccattgattattgccagagcaaaaaaacattaaaagtgacatacaaaaatgcaggaacagcacctgtactcaaatttactcttgatccaagcggctatttcacgttttctaacggcaaatatgaatattacggttcaagttcagccaataaggttggaggaaccaataccttgaatttagttgccaaaagtaaattaaaaagtgactttgctgatattgccgtaacaggcagttatgatattaaaaataagcgcatagcattaatgctgtcagagctcctggtcgtatataatgatgcatatgatgccaatggaaaccgggtgccgggtgtggctcttgattctcatggcggctgcatcgaagggggacagatctcaacgatacccctttcttattatgtgtccctgaaacctctcgggacgatcaagacaaagacatcttccaggaagacaacttccatcaaagtttcatggaataaattaaacggtgtgtccggctacagaatttaccgctccacaaagaaaaactccggttacaaatatctgaaacagctttcatcagaatcaacttcatatacaaataagaagctgaaatccggaaagacctactattataaagtgagggcatacagtaatgtgttcggtgacagatattacggggcatactctgcgccgttaaaatcagggacaaggccggcgaaaccgaaagtcacggtaaaaagaagcggacggcggctgaagatcaaatataaaaagatctccggggccagcggctacagaatttacataagaaccggaaaaaaaggcaagtacaagagagtgaagcagtatacaagcggcaaaaaagtttcctatacgagcaagaaactcaagagaaagaagacttactatgcaaaggtaagggcttataagatcatcaacggcaaaaagtattttggaggctattccaagtcaaagaaagtaaagataaaataagaacaggacgggtgacaatatggaaattaaagtatgtgagacggaagaacaggtgcggtcattggcggaattggcctctgagatctggcacgaatattttgtatcgatcatctcaaaagagcagatcgactatatggtagaaaagtttcagagctatgaggcattaaaaaaagcgatcgcagaagaacactatacctattttctcggatatgacgaaggacaattagtcgggttctgcggcgtgaagccggatgggaaccgtctgtttctgagtaagttgtatctgcacgagaagagccgtggaaaagggctttccagcattttattgagaaaggccatagagtttgcagagaaactggacaaaaaagctatttatctgacatgcaataaatataatcgaaacagcctggatatttacaaagcaaaaggctttgcagcgattgattccgtaaaaaccgatatcggaaatggatttatcatggatgactacatcatgcagctggacttgtaaataaaaaaactcctatgccaaaaatcagcataggagtttttttatttatcatcttcttctggtgtgtcagaagtcttatcctctttagaaatgttatcttgggaatgagtctcttcctcagatgtttcttcttcgtccgtgatgtggatggagaagtaatcacggcagtcttccgctgaatccgggaaaacatcgtcatcgtcaaatgcatctggatcccagtcatcgagatcttcatccttttcctgatcctttaattctttcagcttgtctatgattgctttgatctggtctctggcgatatataaaattccgccgatggagatgatggcagtcacaactttcacaaattttttcaatattttacccatagtgtcgtgctcctttctcatttctggtatcctcattgtaatatgaaaaattggaaaaagcaacgcaatgcttgacaaaataaagtttcatgataaaatctagataagaaatatgattttatttcggaaaggagaatcagatgagcgatttaaaatggggtattttagggtgcggagttattgccaacgaaatggcgcaggcatttgaaaaaatgggaagaaaggtttatggggtcagcagccggacacagacaaagacagaagcgtttgcggaaagatacggcgttgaaaatgtctacggattatatgaagaaatgcttgaggataaaaacattgatgtgatctatatcgcaactccccacagccagcactatgggaatatgaaaaaagcgattgcggcggggaaacacattttatgtgagaaagctatcacggtcaatgaccatcagctggaagagatcgtttccctggcggaagaaaagaatctgacagtaagggaagccatgaccatcagccatatgccgctgtttaaagagctgaagaacagaattgacaaaggagccatcggaaccgtaaagatggtgcaggtaaacttcggaagcaacaaaggatatgattccacaaacagattttttgcactggaagcagcaggaggagcacttctcgatatcggagggtatgccacgacatttgcaagaacttttatggatgaggctccgaatacgatacttaccacagtacagtacttagagaccggtgtggatgaacagtccggtatcattttgaaaaatgagtctgatcagatggcggtgatctgccttaccatccgcgcaaaacagccgaagaggggcgttgtcaccggagacaagggatatatcgaggtatatgaatatccgcgggcttcaaaggcaaccatcacaaatacagagacaggcgttacagaaaccattgaggcgggcagcacagaagatgctctggtatatgaggtggaagccatggaaggaaccgtcagcggtacgttttccgataacaatctggagatttcaagagacgtcatgaagatcctgagcagtgtgagaacacagtggggaatgaagtatccgtttgaataatggttgccgtttcctttttcaattgctataataatagtattgtcaaaaggaggggaatcatgatcaggatatttaaaacttatgagggatcaaaagaattaagagagattacagagatcgaacgcgaatcctgggtcatgatgacggatccgaacgggacagaacttcagatggtggcagaaaaataccagatcgatctggacgatctgagggcgcctctggatgaggaagaacgttcgcgtctggaacacgaagagaattatacgatgatactggccaacattccggtggtacgtgcagaagagggcaagcggctttatgagacgattcctctcggcatcttcattacggaaaaggtcgtgttcacggtctgtctggaagagaccaatattttaaagcagtttacggacgggctggtgccgaatttttatacatatatgaagacgagatttgtatatcagatcctttataacaatgcggctctgtttctggtttatctgcgaatgatcgacaaaagagccaaccaggtggaagagattctgcatgagacatccaggaataaggacttaatccaactctacgatttagagaaatgtcttgtgtattttaccacttccctgaagtcaaatgaggtggtgctggagaaactcagaaaacatataggacttaaacactacgaagaagaccaggagctgctggaagacgttatcattgagaataagcaggcgatggagatgacctatatttatcacaatatattaagaagcaccatgtcgctgtttggttccattatcgataacaatctaaaccaggtcatgaagtttcttgcagccatcaccatcgtgctggagcttccgacgatgatctcaggactctatggaatgaacgtgaatcccgtaggaatgccgttttcgggaagtacgatggggttttttatcataagtgcgttttctgttgctgtttgtgtgatcgcggtgctgattttgaaaaagaagaatctgctataataatttggacacggtctctattgtaaatagtatttttgggcttattaattctaaaaattcggagggaattatcttgagtggataattcccttttaaacttttaagaaaaggccaggtgataagaggtatgaacggaagagtcgatagaaaagaaaggataatattcttacttggattaataccggcatttgcactttgttttcaaatgacaggcaatgtgactaaaaaacagcttaatatgtaaaaacagaaaacatggttgtaaaaaaagcagcctatattgttttaggagtaactgaagagggctataaagaagttctaggtatatgggttggagaaaatgagacagctaaattttggttatcagtacttacagatttaaagaatcgaggtgttcgcttatactaattgttaattacgcttaatttatttacttgttgataatctatataacttatttggtttgtgccaatctccgtaataataagcattgtagtagtatcatagcctttttctttaacaagatttaagtcaacactaacaattttatcaccgatttttacatcatcgccttgtttatgaaatactttgaagccctgcccttttaaattgactgtgtcaattccaatatgaactaaaaggctagttccatcttctctactaatgccaaaagcatgaccagttggatacataacttcaagtttgccacttactggagcataaatatttccgtctgttgggatgatacctattgtttttccaagcatctcttgactgaaaattgggtcattaatactctttgctggaatcatttcgccagaacatggagttataacatcatttataccaaattcttttttcttaaatttatcaaaaagtcccattatagtttttctccattagatgaaattacatctttataccaatagaaagaatctttcttatagcgcttgagtgttcctttgcctttatcatctacatctacataaataaagccataacgtttagccatttcaccagttgaacaactaacaacatcaattgcagtccaaggtgtataaccaacaagatcaacgccatcttcaattgctaaagccatttgtttaatatgttcacgataatagtcaatgcggtaatcgtcgtgaatttctccgttttcaaaaacatctttagcaccaattccattttctgtaatcataataggaacaccataacgatcataaacatgatttaaagtatatctaagtcctactggatcaatttgccaattccattctgttgcttttaagtaaggattcttagcaccacccattatattaccagatacttgggtaacctctttgtttatagtgatgcaatttgtcatatagtaactaaatgtatagaaatcacaaacaccctctttaattaatttaatatcttcatcagtgcattcaaatttaatattattcttttcaaaataatttttcataaaataaggatagtagcctttgatttgaacatctccactgaaacaatttcttaattgatcttcttgttgtgttagcaatacatcatcaggatgtggtgtaagtggataaacagtaatatgacaaatcatagtaccgaacttaaaattcttgtttatttctctaccaataattactgctttagcacttgccacaaattgattgtgcaatgctgcaaaacgtttgttaggatcatctttttgattttggaaagtttccgtaccctcgtttaatataccaccatgattccagtttccaacaccagttgttaagtcattaatttcattaaatggaatccaatatgtaacatcatccttgtattcatttaaaacaaattttgcaaaattaacataataatctatcacttttcgattagaccaaccaccaattttaactaaatttaaaggcatttcattatgataaattgtaactaaaggttcaatattatatttctttaattctttaaatatttctttataaaactttaaaccttcttgatttggtttttcttcatcgccatttgggaatattcttgcccaaccaattgacatacgataaactttgtaacccatctctgccattaatttaatatcttctttatagtaatgataatgatcaatagcaacatggcttggataatagtatttgtcctcattaatatcaagtgtaatttttctttcaactttgtgactaccagcaaccattgcatcagcaaggtttggacctttgccatttaaatcccaagctccttcaacttgattagcagcagtggcgccaccccataaaaaattttttggaaattttgtattcattcgctgtttcctccttttatatttgataacttctcggaatcttcagccctgattttataaggctttcagatcctatttcaaaaaaatcacccacttttcaggatactttcgtatccgagttcctcaaattttaccacgatccctttgctattcctaaaagcacctggaattatatcgtgcagttctggtatctggatctttcccagaccgattcctactcccggtgacggtactccagtccgtactgccgctcagcagcggaaaaagcggacctgtaaatgcagggaaaacggctgtccctcctgcggctgcaagcgtcattattcccagccggactgcaactggggatgggattcccaccgggagtactatttcttcggttcccacctctacatgtatgtaacttccgattcccatagtgatcttccagtattcccacttttggaacgggcttcccgccatgacttgctttcctttctccattcctttttcaccatgaaagcataccttccggaattccgtattgagaagctcctcctggattctgcacatgacgcttacgctgtttatgaatactgcagacgggaaaacatcaagcctttcattgatttgaaccccgggcataccgggcatttcaccattgacgatgacggtgttcctgtctgtaagctgggcttacgtatgcacaaagaagggtatgaggctgccaaacaccgggcaaagtaccggtgtccgaaagcaaaccggaaacgcgtctgcttctgcgaacgtccctgttcaccagcgaaatacggccggactgtacacatctttacggatgacaatccaaggttgtttaacataccgccaagggacagcaaagcatagtacctactatgtctaatgtttatgtctatttttcgtaaatttctttccctgcatgatatttagttgtaaattttcggttggaatctcattcggcgagattccgagaagttatgctttcattatatcaaaaaaaaattaaaagtaaagtatattttattgaaaattttattagataaaaaataatttactaaaatgtattgacaaaaatatattttagcattatgatgaattagtaaaaaagattttattaatttggaggtgattaacgtggaatacatttttagtgaaaatgcacctaaggctattggaccttattctcaagcagtgaaagtaaaagatactttatatttatctggagtaatgccaataaaccctgaaactaattctttagtagaaagtgatatcactacacaagcaaatcaagtaattaaaaatattgatgcaatattaaaagaagcaggaatggatgctaacaacgttgtaaagaccacttgtttcatcagtgatatggaatattttgcagcgtttaatgaagtgtatgcaaaatactttgtctcaaaacctgcaagatcatgtgtggctgtaaagagccttcctaagaacgctcttatagagatagaagttatcgcaatacaataatataaggaggatagaaagtatggcaaagatttctgttgccaagatcgttgatggtcttggtggtaaacccaacattgtaaacgctacccattgtgctacacgtcttagagtcaccctaaaagacaagacaaaagtagataaagaagaaattaaagcattagacggagttttaggtttggttgaaggtgctactcaaacccaaatcgtaattggacctgaagtatcaagtgtttatcgtgaatttattgaattaacaggagtaagtgaagaagcgcctgctgatgaaaacttagacgaagaaaaagtgctaaaagatgatttaaagaactcaaaaggttctattatgacaaaattttttgatacagtagcacaaatatttaacccaatcgtaccatctttagctggttgtggtttcttaagtgctcttgtaatgattttcatggcttgtggagcatcaatgaaagatcctacatttgcaaatttcgtaactattgctatggcagtatttacattcttaccatttttgcttgcttcatctactgctaaagtatttaagatgaatcaatatgttgcacttacaatttgtgcagctatgatggcaccggcttggtcaactatgattacgaatggtcaatctacttcaagcattttaggtattccttttaaagttattaattatggcgggagcgtattacctattgtcttcgcaattatcttggcttcatatgtagaaaaatacagtgataaatttattaaaggtcctttaaagattattttagttcctgctattacaattttggtgtcaactgttgtaactttatggacaattggacctgcatcatattggattggtgaacaaatcgcagctggtgttaactggttatttgctaatggaggtcctattgccggacttgtttatggaggcatttattctatgatggttatacttggtattcatcatggtatggttccagtattaacgcaaatgatttcaaatcaaggtttcaacttagtatctccaacatctggtagcgcaaatattggtcaagctggtgcggcatttggtatttggtttaaatctaaagataagaaacaaaaagctaatgcattttctgcatgtatcgctgcttgtacgggtattacagaaccagtgttatatggtgtaactgttccaagtggtaaaccattcttctttggttgcatcggtggagctgttggtggtggagttgctggacttctaggactaaaagcttatgcaatgggtggtccatcattccttagttttggtatgtttatgggtggttcaaatgcctttatgaacatgggtcttgtaatggtatgtttctgtgtagcattcgttgtggcagcagctttaactattgtgtgctggaaacctgctaaataaaactcaaaaaatataaaatagaattaatgttagagagtaatatattactctctaattagtatatggagataagagtgaaaaataaagtagattttgaggattcatcaattcctcatagtcagtcggggtaaaaggcttcttttcggaaaccatgtggaaaatacagaccatcatcatacgtgcaatggcgataatggctttcttgtgaccacaacactttttgatacgtccatattagcaattattctcgataagccagttgtgaaacctttggatatccgagttaatggtggaaaaagatttttgattatactcggaaattccgttcttgccggtggttacgatggttgcaacgataacatttttgtggacatcaagcccatagcagatggagtattttagcttcatcataagtatcaccaccttaactaaaaaaggaatagcagcattgactgtcatcctgcgactaaataaacatggtttattaccaatgataagagtccgggctctgtagtgtattgctattccataggaagattatataacggaaaatggaggggcacaacttttttcattaacctgtttgtgccttgagcgaagcgaaaggaatggtaaaaaaaatgaaagaaaaaatgatacacgcatttaaagcggctagtggtggattattctcaaacgttgaaaaagctgatgtaggtagttcttatcaagaaatggaaaaacaaggaattgctcttatgggatgggcagatccgtttatgccagattgctcaatgccaaaatttattgaagaagcttggattcaagctgttaaagatgaatcagcgcctcactatactgctccgattggtaatcaagaattaaagaatttgattgcagaaaaaatactaatacaaaacaaccttaaagtagatccaaatcgtaatattttaattacaccaggatctgatagcggtctatttttcagtatacttccttttataaacgatggtgatgaagtaattattccttcaccatcttatccgaacaattatcttactgttgatattatgggcggtaaggttgtaccaatggaagttaaagtagaaaatgcttatcaaatagttaaagaagatttagaaaaactagttacttctaaaactaaaatgatcattttaactcatccaaacaaccctacaaccgttgtttataataaacaatctttagaagcgattagagaagtatgtattaaaaatgatttaattcttgtgtgtgaccaagcatttgaagattttacatatgagaatgaaatgattactccatcttcaatggatggaatgtttgaaagaacggtaacagtattctctttttctaaaggaatgggattaagcggtcttagagttggttatgttgtatgtagtgatgtcatcatggatacaatgttcgctaatgctgttggagttattggtgcaacttctacatcagcacaaaaggccttaatagaagcaatcaaacatccagaatttatgaatgtatttaaagaagcctttgactatagaagacataaggcttttgaaataattaactctattcctaatgtaagttgtttattacctgaatccggtttcttgttatgggtagatgtttctagaattggtaaatctagtgatattgtttcttatcttgtcaaagaggctgcagtatcttgtaatgatggtgtgaactatggtgcgggaggcgaaggacatcttagaattgtattgggtgtttataaagataatcaaagagtagttgatgcgcttgaacgtatcaaaaaggcgctaattgagtatcaaactatttaattatgtgatgaagtatgttaatattttagtgtaaataattttaatgaaagaagaaatgtaatggaaaatattaatttgactaaaattgacaaacaaatcctagagtcttataaatactttgtcaatggactatcggcttatttaagtaactcttatgaaatagttcttcattctcttggtaatctagaatcatcagttattcatattattaatggcgaacacacaggaagaaaagttggagctccaattactgatctagctctacaaatgtatgacaacatcaaaaaaggtgaagctgactacattgtatataatagtaaaaataaaaatggagagccattaaaatcagctaccattgcaataagaggagaagaaaatagaattattggtttaatatgcataaatatgtatttaaatacttcctttttcgatgttttatcttcgtttatgccatcagctgctagttttatgaatggattaagtgttaatgaaagctattttaatgatacagatgatttaattaaaaacgctattgatgaagaaactagaagtgttatagctaatgcttcaattttaccttctaaccgcaataaagcaattgtggaaagattatatgataaaggcatatttaatttaaaagattctatcttgaaagtcgaaagtattatgggtatttctaagaatacaatttatatgcatattagaaactataagaaaagatataataaataaatataaaaagattacctgctgtaagacttagtaatataggcgataaatgtttttatataaataaagcctgttaaggaatagaagtagtcttaaagcaaaaaggatatgaatttcatgggcgtgtcatatacaaggtcaatgaattagatggatatataagacaaaggttgagagtaaacttttcttgtagaggaaagaaacatggaggatataatcaatgtagattattgggagtgaaataccctgataaattctttggactagacatgactttgttaagtttagttgacacatttttcacaaggattttatatcttatgcagcttctttccgggcattatagtattgctgtcgtttgatcataggagggagtcctccattagcggaacaaatcctccgattattccagtagctgatgaaatatctccagatgactggcttgagttccccggtactcattttttctgtaccataacggccatacagcagctcggttttcattctggcccacatgctctcacagcgggcattgtcgtgacatctccctcctgctctattcatactctgctctatttcatatttgcaaaccgcatcccggtatatctggctggtatactggcttcccggttttataccatatcagtcatgaggacaatatgaaagtcaaggttgccgtgaaattcatagacaatcagacaaaggcaacgcaggtatcacacagtttgaattggtgctatataaggataggaattggaaaatcattcagtagtagagaattcacactttttctgatgtggacggctgaaatatcttgtgtttcacttgatattccaatataataaggaatatagaagagctatcttgaaaataccaaaaaaaaggggaacagccatgctcatgaattgctacgctcagacagacaaaggtaacctctatttttggcatacccaaaattaaattatttagaatgtaaagacatattctgcccagagttttacgggagggatgtgccttttatcgaataaataattattttgaaaaaaggtgaaaacagaaatgaaacgaataaaactgctgacatttttgctggcgttcacaatactgctgacgacaatgcttcccacggtggtttttgcgcaggggaatgattccggtacatcctttgaagttggcgattcggttgaattgaaagaggcattcaaaaagattgagaatactgaaggcacttataccatttcattgaaggaggacattactgtagaaggcgagtcatattcggtcagcctcaaaaaaggtcgtgaggtaacattacttggtaatggacataccatttattttaaaaataaatatgggtcattgcagacaaacggcggcacattaaatcttggcaatgaaagtgccaataaattaacacttgacgcgactggaacaaatcgcagagaagctgtgatcgagattttcggcggaactgtcaatatgtacgaccacgttactataaaaggaaacgacaacgcacagaagagcaccatgggaggaggagttaatgttgaaagcgctagctttgctgaatatggtgatagtactttcaatatgtatggtggtgtgatcacagaatgcaagaatcaacgcggcacgggtggcggagtcagtgtagttggagttgatgatgctaatggacttaaagctaccttcaatatgtatggtgggtccattactggcaatgaggcaataacaccttatacaggatcaaatatgtatggcggcggtggcgtcgcagtattaaaaacaaccgcgacttttaatatgtatgacggtttgattgaggggaacaaagcggtccattgtggcggtggtatctatagttgtttgggtgccgtaaacattgaaggcggagcaatccgaaacaatacctgtgattcagtgataggaacaacatatggttccggcggaggtatttatagttattacggcacaacgacgattaaaaacgcagtgattgaagggaactacgcgctttatggcggtggaatatatgcctatgctatcaattatagtacgaagtatcctggaaaaataactatatcaaagtccaacattcaaaataatattgcgtcgcgtggcggcggagtttatgcctcatacagtaaagatgtaaggttgtctgacagcacgatcaatagcaatgaggctcacaatggcggaggcatattagcttcgaaaagtacgatcacttttgaaaacagcgaagtcagcggcaataaagcatacaccggtagtggcggcggactgtatgtcagcagtgcaagtacggtatccaccgacagcaaaggcaatattatctgcaacaataccgcaggcggttatgcagcagatgtttatttaaagaaagactctataataacattgccgaacgccaaggatatggacaaagaatatttggcagacaatcaaaactttagaattgatggttggtattgggatgcagcagattcgcgttacactccaagcgaagatggagaaacggcagatactgacaatacaactagtgggctagcgctggttgcatcctacagagttcccggcatgcttgtcgttacctatgaactgcaggagggagagtggacagaaacaagggacatttattctgagcaggatggaaaatatatagaaaatgtacctttgcgtgaaaaggccaatgaaccgagtgctcctgaaaaggaaggatatgtatttggcggctggtacacagacagtaattacagcgatgaaagcgagtatgatttttccgctcctgttacaagacacataacactgtatgcaaaatggttgaagaagatggagcctttgaatgcagttcctgcaatcatggcagaggataagactttgactgtaggcgatacctttgaccctctgaaagatgttactgcttcagataccgaagatggcgatcttacagcgaaaattgaggtattgcgcagtaatgtagatacatcaaaagcaggaacataccaagttacttacaaagtaatggatagtatgggcgcttccgcaacaaagacgattaccgttactgtcaaggcaaaagacacgcagaagccaacgacagacgataacgagaaaccgtctgcaacggatacagataagaaaccaattagtacagataaacagacaacgtctaacagccctaaaactggcgacagcacaaatatgacaacatggcttgcactcatgttcgtatctcttggtctgttggctggcatattcacagtaaggaaattacgcaaaagcagataaagactgtgagaaattttatggaaagagatatttttgaggacatgaaaattgaaacggaatgtgcatatatttaagatttgccctacatcagagaaacagtagaaaagaaactatttgaacttccgtttgacctctattccaaggaacagcttcaggaattctgcaactttgtgatggtatgacctattccttgaatattatgtaaagcttgatgaatatgaattctggctatttgtgataggaaactgtaatcgtcaatgctgatctgtatcaaaaagcagcagatgtatcttgtaaatttacgcaggatacgtatcggtttacagggaatataaaaggttaaatacaggaatctaatattttccagcagattccatacagacatcacgacattggtttttaacaagccattctttgaactgccgccgggccgatatgctgtatttattttcaggggaaaaaatgagcacagccgttatgattttgcaaaatatgggaaagaaagggggacatttcgtttgattgagaaatgtccctgtgctgttttaatccagatagtgcttcatatgtttcagcgcattcttttccagccggctgacctgagcctgtgagatactgatctcatcggctacttcggtctgcgtcttgccgtcaaagaagcggagcttgatgatgttgtattcccgttcagggagatgttccatggcatcttttaaagcgatggattctacccataattcttctttgtttttcttgtcttttacctgatccattaaaaacagagtatctccgccgtcctgatacaccggctcataaagagaaagaggtgtggcgatggcatccagggcgaagagtacatcctcttttttcatttcgatttcctcagcaatggcttcgatggtaggctctttgttgaattttttcgtgagggcctcctttgccgtgatggctttgtaggcaatatccctgagtgaacgactgactctcatggaattattatcacgcaggtaacgccgcacttctccgatgatcatcggaaccgcataggtggaaaatttaacgttcagggagcggtcaaaattgtcgatggctttcataagcccgatacatccaacttgaaacagatcgtcggcattctcattgctgccggaaaaacgttgaatgacacttaaaactaaccttaaattgcccttgatgtattgttcccttgcttcctggtcaccctgttcgatccttatgaacagttcttctttttcttcattggtgagtaaaggaagagaagcagtattgactccgcagatttcaactttattaagtgccatgataattcctccatttgtaaattgttcttgcgaacgatatattaaaatcattcaccaatcaaaatggatttatacgatgaaaaaattgccagaccgtttgacacccatatttaccaatgatattatgataagaagaaaatatagaaatgaggaatcatatcatgaaaaaattactgctaatttgtatgatgatatgtcttgttttttgtttggggggctgcaattttccctgggacaaggaaaagacagaagataaaaatgtcaaaaaagaaaatataacagcatcagaagtaaaagattccatgaagggaagacagctgattatcggtgtgtccgacggtatggcgccgttttcagtaagagatgaaaaaaccagggagatgaaaggttttgacatcgatctgataaaggggatcagccagtatctgggctttgagtacaagcttcgcgtcgctccgatgaggaagcttacggatctgctcagggagaagaagatcgatcttgctatctccggcatttgtattacggacagccgccaaaaggagtttcagttctccgatgtctattttgaaaatacattaaaagttatggtcaatacagataaaaatataacagacagaaaagaactggtcggaaaagccataggggtggaggagggaacctctaacgaagaatatgcacagactaacctttctgaggagaataagattaaggtttatccatccatggacaaggtattcaaagatcttgaaaaaggaaagatcgatgctacggtctatgatgcaacaggcgtggattattttatggcaaattataaaggagacaaaatctccgacctcgatgagaagcttaactcagcagagagcaactatgggattatgttccggaagaaagatccttctatcggcaagtttaatgtgacgcttcaggtattgaacacagagggcacctaccaaaacattaagaacgagtggattggatcggaagacgaagattaagagggaaattcatgaatattgtttcaattgtattcggacagatcgtcatgatgttttgtatgatggctgtgggggcagccgcctataaggcgggcctcataactgaacggggaagcacggatctttccaatatcaccctttacttagtcattccatttgtggtgctcacttcttttcagattgagtttgatgcagacatatttcatggaattctggttacctttgttttaggaattgcggcacatgcggcagcgatcgttttgtcctatctgctgatccgaggaaaggataatgatcggacagttctggaacggttcagcattgtgtacccgaactgtggttttatggggatacctctggcccaggcggtgctgggtccgaagggggttatttacataacagcgtttattgccgcacagaatctgtttatctggtcccacggagctgccagtatgcaggggacatttaacctgggatcggtcaaagaattattcaaagcacctgttatgatcgcaacatttgcaggacttttctgttaccttcttcagattcaattccctgttctggtctacaatccactgaaggctatcgctgatatgaatacacccctggcgatgatcatatccggaactgccatcgcgcagacaaatcttttgaagacactgacaagacccaggatttatgttatgacggcattgaggctccttctcgtgcctatggtcatgtttttgatccttcttttcgtaccggtatccaaggatcttaaaatattgtcgctgcttgcctcatccgcatcgactgcggcgatcacgaccatgtttgcggtgaagtttaagaaggatgtgggttacgcggcagaattatttgcagtttccaccatcgcagcggttgccacgctgccgttcatgatctccctcggagaaaaattcttttcataaaggacaaagtgggcaagcccacacctcatctccctaaccccttaaaatagaaaatcccatggttcattctgtcaaaagaaccatgggatttttgaattcggcataaaaatcagctgttttggattttcagaaaatgatacagccagctggcctcttcatcagtgagatgaggagagagactgtcgaagacaagccggtgataggcatagaggagacggatttctttatcattgagcagcgcctcatcaaccccgtccatatcaataggaaccaacgtcaggtgctcgaattctaaaaagctgccgtattcattctgccgctgctttctgcacaggagcatgttttctgtacggattccgtattttcccgggatatacactcccggctcatcggttgtaaccatgccgggcaccaggactgcatccagctgattatctctgatctgccagcggaaggcgttggggccttcgtggactccgagaaaatgtccgacaccgtgtccggttccgcaccggtagtcgattccttcttcccagagggggcctctggccaagatgtccaggctgcttccccggcatccaagaagaaatttggcatcggaaagggacagcatactttttaatacgagcgtaaagttccgtctctcttcttcggagatatcacctaagataaaagtgcgggtgacatccgtcgttccggtcagatactggccgcccgagtcgatcagaagcattccttccggttccaggcagacatcggattcttcagtggaagagtagtgcatcatagccgcgtggtctttgtaggcgcagatggtatcaaagctcggtccctgatacagaggcagctttctgcgctcctcttccagacggtcctggacggaacgttcagtcataggaacagaaccgatgttttgcttcagccaaaacatgaacctggtcatggcaatgccgtcagacaagtgacattctttaagccccttgatctgtgtctcatttttcaccgctttcatgccggaagaagggttttcgccaaaaatgatctggtttttttcgagttccaggtaaagcttgtagtttacggtatccggatctatcagtatgcttccctcctgtttttttaagaaagaatcgatctgttcataaggcagaatcgttatcttatcctgttccagacggcgtcttacttcttctgaaagacaggtttccctcacaaataggcagcagctttcctgtgtgatccatacatagctgtaaaacagaggcgtgcagggcatgtcattgccgcgcagattgaagatccatgcgatatccggcagagaggcgataaaatgagcccttgcggaaactgtctccatacagctgcggattcttttgagcttcgacggcacagattccccggcataaatatcttcatggataaaaatcggggatgctgcggcatccgggcggccggtccagagatcctctgcgagagtatgatctgtttccaggactgctttttttgaagcggccagcctggacagttttcttccgtaagcggtattgatcatacggccgtttaagctgaggacatcgccctcactgagatgctctgtgagatattcaagtatagtcggaacgccggaaacacccatcttcatcagcttcatttgttcaggatcgatctgtgcttccgcctgggtaaaatatctcccatccgtccagagccggctttcggcctgctctgccaggactgctccggatgatccggtaaatccggagatgaattggcggcacttatagtgatcgtccacatattcggactgatggggatcttcactgggaatcaaataatacgtaagattcttttcaatcatagatttctgaagtctagccagcggtgtagtcataattcagaacctccttttattgttgtggtttttattataacacgatataataaaaaatagaattttagaatatgtgcagaaattttgcagctgaatgaggaggacattaaggatgaaaaacatgctagtggcacagtcaggaggaccgtcggcggcgatcaatgccaccattaccggcgtgatcgacgcagggcttgcgagcagccgggtagaacatgtatacggtgcactgaatgggatcaaaggagtattaaacgagaattttgtgatactggatgacatatgcaaaaaaactgaaacaagagatctgctggccatgactccggcagctgcgctggggtcctgccgctggaagctgaaaaatccggaagaagataagagagagtttgaggagatcatccggatcttaaggaaaaataatatcggatattttatttacaccggcggaaacgattctatggataccgtctataagctttccgtgtactgtcgggaacacggagtggatgatatcaagatcatgggagctccgaagaccatcgacaacgatcttggagagacagaccattgtccgggttttggctctgcggccaaattcattgccaccgcttttacagagattgcatgcgactgctatgtctatgatattccgtctgtgacggttgtggaagtcatggggcgcaatgcaggatggctgacggccagtgcggccctcgcaagaaatgaagaaagaaatgtgccccagctgatctacctgtgtgagagggcgtttgatacggaacgttttgtgaaagatgtaaaggaagcgctggatcgggaaaataacatcatcattgcagtcagcgaaggattaaaggatgcccggggaaattacgtcggagaagaaatgaagtccgggaaagaagatgcttttggacataaatacctgtcgggcatcggaaaatacctggagcaggtgataacggataagattggctgcaaggtccgctctgtggaactcaatatccttcagcgctgcgccggatacatgctgagtgaaacagacatcatcgaatccagaaatctgggggcctttgccgccgtcagcgccatccggggcgagaccggcaagatgtccgctttaaaacggatgccgggagataactaccaggtggagatcgtactggccgatctgtccaagattgcaaatgttgaaaagacagtgcctcttgaatggattacagaggacggacacgacatcacggaggagctggtggattatttaagacctctgattcagggggaagtgcggattccgtataaagacggagtcccggaacatttcattctctaggggattccgtaggaatttcttatttcataggaaagttctacgaccttccctatgaaataaaaacgctccgcgggttgtgcacagatgcgtaaggaaattatttgcctgcggcaaattgcatctggcacgcaaagtttaaaagcccctcaaagagtgaggggttggggcgttgaagtgggcctgcccactttgttctagtagcgaaaaaagaggaacttttctgtcagtgtcctggaagaaaagttcctcttttttatttgcggtttttcataatatattggtttagttcggctccgatgaacagaatcatcatacaaaaatacagccagaacagggtgagcagaataccggtaagccctccgtacataatgctgaaaaatttaaagttatcaaaatagattgaaaacagggaggataaaatgatccatcccgctgagctgaatatcactcccggcatgacttgcttggctttgaagtgttcacttggaagaaagcggtacatgatgaaaaataccaggaaaaatataaaaaatgcaatgccgaaacggatcagcaaaaatataatatgctggttggacagaaacggataaaactgatacagctggttcagcagtgtgtttccgaataagagcacaataatcccgatcaggacagctaccgcgatgaacgcaatatacatagtggagataaaccggagcacaaagtaattccgtttttccgggatctcgtggatcgtgtttagaccggtcatcatggaaaggataccttttgatgcggaccacagcagtgtgatgatcgtgaatgacatgtaggttgtcgtgatttttccatataaagaattgatgacggcaaccaggctgacactgtactgttccggcagatagtagtttacaaggtcgatcaggtctttcggcgtcacgggaacaaagcgcatcaggctcagcacaacgatcaggaacgggaaaaaagaaagcaccgtaaagaatgctgcctgagcggaaaaggcagtgatatgatccttctgagctttcgcgatcacggaattcagaagggcgattaactttaacatataaatacctctcagatcatattaatatagcaaaattttatacaaatagtttatatattctatcataagcgtttgaaatactcaagaaaaagctgaacgccataggaataccgggacagcaggagaggaagctttgttttatatagaataaatcttaaaaatttataaacaaattataaagaaagtggttgacatagggggcagggtttgataaaattggaaataagttaaggaatacgaaagaaggattgttactggtaatgcaggctaaaccaacttatgagatttatacagatagatttcgataggtgtggtttattttttttcttaactgaatattttacaatacggagtggaactgtgcaaattacaagaattataaataataatattgtaatttcagaagataacagccatcgtgaagtggtgctaatgggaagaggactgggctttcggagacatcccggagatgtgatcgactcagataaagtcgagaagacttacataatgaaagaccatgggatgacacatcgctttcagcagatggtagcagacatccccatagaacgattggaaatatgtaatgaaattattcaatatgcaaaagacactttgcaaaagaatatcaatgacaatatttatatttctctcacagaccatattaattttgccattgaacgggtagagatgggtgttcccttccagaatccctttttatgggagattaagaagttctactaccaggaatatctgatcgggcaggctgccatccgcatgatcgagcggaagctaaaggtcactctgccgcaggatgaagcggcgtttatcgcactgcatattgtcaatgcagaactggatctggatatgacggagatggtttccatgaccaagcttacgcagaatatcttaaagattgttgaggagtgttttcctgaccagatggataaagaatccgttttttacgaaaggtttatcacccacttgaagttttttgcacagaggatctttacgggcaatgaagtggagagtgacgacacagagttccaggagattatccgaaacaagtatcaggaatgtcttgactgtgtggaaaagatcagaatttatataaagaatacatgcaaccatgatataacggatgaggaaatgatgtatctcaccgtccatatcaagagagtgattacaagataaaagttcatattgatttagaataaggattgttactggtaatgcaggctaaacctgattcaaaccgaaggatttttgaattcatatgttttgcaaaatttgttgagctgtgtggattgaaaagatccggtgtttgagtcaggtttttttatttcattaatgtttcacgtaaaatcacccccagcgggggattttataaataggaacctgaattcttggttaatataaaagaataaagattccgaaagataattagaaaaggaggaatgtttaaatggtaggaattattcttgctacgcatggcggatttgcggatggtattatgcagtccggatccatgatcttcggtgaccagcccgatgtggcagctgtaacactgcagccgagcgaagggccaaatgacatcagaaagaagatggaagatgcaatcgcttcttttgaaagtcaggacgaagtattattcttagtcgatctttggggaggaactccattcaatcaggcaaacggacttgtatcagaacatgaggacaaatgggcgattgtagccggcttaaacttgccgatgctgatcgatgcctatggctcacgtatgacgatggagacagctcacgaagttgcggttcagatcgccggaagcggaaaagaaggggtgcgcatttatccggagtctctggaaccgaaggaggaaccggcagccggacagcaggcagaagcacagcctcagggagcaatcccggaaggaaccgtattaggagacggacatatcaaatttgtgcttgcccgcattgattcccgtctgcttcacggacaggtggcaactgcatggacaaagacaacacagccgaacaggatcatcgtcgtatccgattcggtagcgcatgacgatctgcgtaaaaaactgattcaggaggctgcacctccaggggtacgcgccaatgttgttcctgtgaacaaaatgatcgaggtctcaaaagacccccgctttggaaacacaaaagcactgctgctttttgagacgcctcaggatgctctccgtgccatcgaaggcggagtggacatcaaggaactcaacatcggctccatggctcattctgtcggaaaagtagccgtgagcaaagttgtatctctcggaaaagaagacatcaagacttttgcaaaattaaaggaacatggaatcggctttgatgtccgtaaggtgccgagcgattctaaagaaaacatggatgagatcattaaaaaagcagaagccgagttatcttaggcttcacacattcagaaaatagaggaggaattataatgtcagcaatttcaatcgttttagttattatagttgcctttctagctggtatggaaggagttctggatgaattccagttccatcagccgttggttgcgtgtacattaattggacttgtgaccggtcagttagaagcaggtattattttgggcggtacattacagatgatcgctttgggatgggcaaacatcggcgccgctgttgcaccggatgccgcgttagcttctgtagcttccgctatcatcttagtccttggaggacagggcacctcaggtgtcagcactgccatcgcagttgcgattcctttggcagttgcaggtttattcttaacaatggttgtacgtacactttccgtggcatgtgttcaccgtatggatgcagctgctgaaaaagcaaatttcaaaggtgttgaactgtggcatatcattgccatcgctatgcagggactccgtattgcgattccggcgggagcgcttctgtttatcccggcaacaaccgttcagaaattcctgacatctatgccggcatggcttacagacggtatggcaatcggcggtggaatggtcgtagccgttggttatgcgatggttatcaacatgatggcaacaaaagaagtttggccgttctttgcaatcggtttctgtgttgctgcactttcagatctgacattgatcgcattgggagctatcggtgtatctctggcattgatttaccttacactgtctgagagcggcggttcttcaggcggcggaggaagcaatacaggtgatccgctcggcgatattctgaataattattaattgaaggaggtatgaaaaatggcagaaaaagttacattaagtaagaaggaacgattgtccgttgcattgcgctctaccttccttcagggttcttggaactatgaacgtatgcagaacggtggctgggcattttcaattatcccggcgatcaaaaagttatataaaacagaagaagaacgctcagcggcattaaaacgtcacttggaattcttcaacacgcatccgtatgttgcttctccggttatcggtgttacactggcattagaggaagagcgtgcaaatggggcagaggtcgatgacgcagcgatccagggtgtgaaagtcggtatgatgggacctttggccggtgtcggagatccggtattctggtttaccgtacgtccgatcctcggagctctcggtgcatccctcgcaatgacaggaaacatcttaggaccgatcttattcttcgtactgtggaacgtgatccgttgggggttcatgtggtacacacaggaattcggatacaaagccggcgcaaagatcacagaagacctttccggcggattactgcagaaagtcacaaaaggtgcatctatcctcggtatgtttatccttggatcactggttcagcgatgggtatccatcagtttccagccggtagtatctaaagttacattaagtgagggagcgtacattgactggggcaagcttcctgagggagcaaaggggatccagcaggcatttgagcagtatgcatcaggcctgtcactgacccctaccaagatcacaactttacagaacaacctggattctttgattcctggattagttccattattattaacattattctgtatgtggctgctgaagaaaaatgtttcaccgatcatcattatcatcgcattattcttagttggtattggcggacaccttatcggattgttataagctaatgaaaaaagttcggagcaatccgaactttttttattctttgaagtggactttcccactttgtttactgaacaatatcgtgatataatgtttaggatactgtataagaataaattagaaatggagagttgctatggctcagtcaataaatacaaaagtagatttggtgatcagcggaacttcttatcacggtctgaacagttatggaaagatcatgatcggcgataaaggatttgaattttataatgaccggaatgtaaatgattatattcagattccatggaaggaagttgactacgtgattgcctcagtcatgtttaagggaaaacacattccgcgctatgcgatccagacaaaagaaaacggaacctattcttttgcctcaaaagagccgaagaaagtgctgcgtgcggtcagcaagtatgttgcgccagaccatatggtccgctctttaagcttttttggagtgatcaaaaagaagttaaaagccaagtttaacaaataagtcttaggagggataagattatgggacatattttaaaaatgaaaccagtgtttaaagagatgatctggggcggacataagcttaaggatgtgtatggatacgagatccccagcgaccatacgggggagtgctgggcagtttctgcccataaaaacggtgactgtacgattgaaaacagtgagtttgccggcaagacactgtcatggctttttgaacaccaccgggaactgttcggcaatatagagggagaggaattccctctgctggtaaagatcattgacgccagagatgacttatccgtgcaggttcatcccaacgatgagtatgcaagggttcacgaagactctctgggaaagacagaatgctggtatgtgcttcaggcagatgagggcactaagatggtcatgggccatcacgcgaaaacaaaggatgagtttatcaaagcaatcgaggaagacgactatgacaatctcctgaattcctttgccatcgagaagggggatttcttttacatcccttccgggacactgcatgccatctgcagcggatctctgatctatgaagcccagcagtcctccgatatcacttaccgcgtttatgattatcaccgcaaggatcaggacggcaacgaaagacagctgcatgtacagcagtccatagacgttaccaatgtgcctgcacagattggcagcagcaaatccttccgtgaaactcagctggaaaacggaacgaaagtaagatatgttgagagcgaattttttaaagtggactgctatcggttaaacggtaaaaatacagtagaaaacgatgcgccgttccagatggtcagcgtgatagaaggagaagggatgatcgatggacagagtgttaaaaagggagatcatttccttatctgttcggatcagaaggaaactgttttcggcgggacaatggatgttatgatcgcaacgctgtgacctgaattataaagccgaaaaatcaggtatgtctttgatatgaggtattttaggagggaaaatgtgaaagacaaaatattcggggtattacagcgtgtgggacggtccttcatgcttccgatcgcaatcctgcctgtggccgggctgctgctgggaatcggacaatcactgacaaatgaaacgatgctcaatgcctatggcctgatgggggttatgggaccagatacgattccgtacgcaatcttgaaagtctgcggggactgtggaaatgctgtgtttgggaacctgccgctgatctttgccattggggtagccgtgggtatggcaagagctgaaaaagaagtagctgcactggcaggagctatcgcgttttttatcatgcacacagccatatcggctatgatttctttaaacggaggagcagaagccatgcgtgagggtgcaacggcttctgttctggggattacctccctgcagatgggagtgttcggcggtattatcgttggacttggagtttctgcgctgcataatagattttataaaatcaagcttccggaagtattgtcctttttcggtgggacaagatttgtgcctgtgatctgtacggtcgtatttgtatttgtgggaatcctgatgtattttatctggcctcccattcaggatgcaatgtacgcggcagggggcatggtcagcgcttccgggtatttcggtacgtttatctacggggtcatggagcgggcactgatcccgttcggcctgcaccatgtattttatctgccattctggcagacttcgttaggaggtacaatggagatcggcggaaagatggtcgaaggcgcccagaatatcttttttgcccagctggccgatcctggaactatccattttgcagtgtccgccacgcgatttatgacgggcaaatttccgctgatgatctttggactgccgggtgccgcatttgcgatgtacaggtgtgcaaggccggataaaagaaaagcggtggccggcctgctggcctctgcggcgctgacgtcgatgctcacaggcatcacggaaccccttgagtttacctttttatttgtggcgcctggattgtatgcgatccactgcgttttcgcgggagctgcatatatgctcatgcatatgctgaagatctgtgtgggcctgacattttccggaggcatcattgatatgttcctgttcggtaccctgcagggtcagtcgaagacaaactggctcatgttcattccggtggggattgtatattttacagtatattattttttattcagttttctgatcaggaagctggatctgaagactccggggcgggaaaaggaagaccagaatataaaattatataccagagctgatgtggctgagaaacctttggagggcagccctgaaattgacgggtctgatatatcggctctgatcgttgccggcctgggcggtaaatcaaatgtgaaagatgtggactgctgtgtgacgcgtcttaggtgtacgatctcggatcctggcagggtaaacgacagaatcttgagagaaagcggctcccggggcatcgtaaagaaaggcgacggggttcagatcatttatggaccgatggtcactgtgataaagtccaatctggaagattatctggcaagcagcttgtctgacagagcggcggaagcaccgagagtccctgtggcagaagaggtgccggaggtggcagtggaaactgtctgtatgccgatcaatggagaagtagtagaactggatgaagtggaagatgaggtctttgcagaagcgatgctcgggcagggatttgccgtaagaccttctgacggaaacctgatttcgcctgtagacggcacggtcactgcggtgtttaatacaaagcacgccatctgcatcacgtccggcggcggtgctgaggtcctggtccatatgggaattgatacggtgaaacttgccgggaaatatcatcatgtgaaggtagagccaggcatgagagtgagaaaaggggaccggatcgctgagtttgatcttgaagagatcaaacaggagggttactttgtcacaacaccggtggtggtgagcaacagtgaagagtatacaagcatcaccatagaaaataccgggcacctggaagccggaacaaaagtgctgacattaaaaaaatagaaatagaacttatatgtaaaaaagatctttctgcaaatgtctgcaggaagatcttttttctggagaattatttactttgatcctgtaaaagctggatcatcgtatcagttgctgcattcacagtattgatttcagactctactgaacgggatgcgatgtgggctgtctggataaagtgatccatcttgagcagctcatcaatccaaggttccctctggggaggttctgaggtgaagacgtcggatgcacaggcgtagatctccttgctttttaatgcttcgtaaagtgcatattcgtttacaattccgccccgggctgcatttactaaaacagccgtgtccttcatcattttaaattctttgattgagatcatgtcctttgtctcttgtgtaagcggcacgtggatggagataaaatcacattccttcaggatttgttccacagatgtttgttttgcgttgtattcagccagtacatcttgggcagcgtcaaacatatcatagatcagaacttccattccgatcccatttgctattcttgcaacatgttttccgatattaccaaacccgataataccaattttcttatgaaagagttccagtcctgttggtttgttccaaccgtgacttttgacatttatagcattactcacaatatgccttgcagccgcaaacatcattccgatggtgagttctgcgactgcattggaattcgttccaatacagcggccgactttaatccctagttcttcacagacagaaagatcaatattatcggtcccaaccccgaatttcacaatggctttcaggtgcctgcattcccggaggagttcttcattcagttcgtcaacacccgcgatgatcccggacgcccgctttgctttttctgcaaacacgtcttttggaagtggtctgcctgtatgattgacgtccatttcatagccaagtgcttctaaacgttttcctgctttactgccgtattttgcataccctctcggtgttactagaatcgttttcataggctcatccttttcttacgtctgttacaatatcacgtagcttttttgcgtttgccgcaatttcctctgtggaacctttggtaagtaatccgcccaggccaacgcagtcagctccgttttcaaaccactctgcaaggttgtcgaagtcagctccgcccgacgccatgaccggcacctgggggcatggcacttttaccactttagctaagctggggccgtagtaattggagattggaaatgcctttataaaggatgcgcctgcctttagtgccgtcaacatttcagtataagaagtacatcccggcgcatatggaatctggtataagttgcaaatttgcgcgacaccttcgtcataacaaggggcaatgataaattgtgccccgctcataattgcaaggcgggccgttgttccgtccaggacggtgcccgcgccgaccagcagatcctccttatatttcttttttaaagcagagatcacttctccggcgttgttgttggtatagctgatttcaagcacgttgactccgccatccaggcatccctgggcaatctcataaccacgttccacggtttctacccggacgattgccattaagccggtttttttgattcctaaaataatttcttcctttttcattcttatctcttctttctttataagtctctggatgtaataaatttcattttgtctaatttggtctttttgaaactatccttaagatgcgtaccgcctgtgtagttatcaataaaatatccctcaactaagacaggatgaacgtatacctctgccttctttgccttcataagctgaggattccggcttttgcggtttttatcaaaggtggccacactgctggaatagtctgtatgacgaaggtgcagctgatccatttttttcttccactgggtgccgtagaaatgccgccatttactcccgttaaaaaaactgtttccaatgtaacggacagattcaaatttgtatttttttaacaagggtatcaatccgtaaagaaccggaatatcataaaatgcacagtggtgggagtctatattcattagagaaaaacctccgcttaaatacttttggatctgtgcttctatttcctctgcgatgacatctgcgtacattggtgtaacccggtgcagaaaatcggggtgaaaatcaaacagatctgatctggcatattgtttcagtttcttgatcccggcggttaacggggtcccatcgaacagattgatatgtaagccgaccttgtgcttaaagtcatttttttctgccagggacactgcctcatcaaaataattcgtgttggtcaccacagaagcctgggagcagaaaccttcatcgaaggcttttgcgattcccagatttgcttcatgagtcaatccaaaatcgtcagcatttagtataatcttcatggtttatcctctaaaagaatccgatcagtgttcccactgtgccaattaggatcagcacgagcaatatgatgttgacattaactttttttctcaacataaatacagttaatagagtgattcccaacggcaggataccttttaagatactgtcaaataccgcagtctgtacgtccagtgtacctgtgcttaaatttaactttaatccgcaggatacagttacataggatgccaccagtcctcccagtaccgttgccccgacgatggttgctttttcggttactttgtttaataaaccgcttccgatgatctttccgattccttcgcgtcccatatagtaacctttggtataggataagtaaccaaggccgaataacacaacgccaatgattatcaggtagatgatcggtcctaagaagtttccggcctttgccattccaaggataatacccaatgctatgggggataacgttccctgccagattgtgtcgccgatgcctgccagaggtcccatcaaacctgttttgatgcttgaaatcatttcttcgtctacatcttcaccgtttgctttttgctcttctaaggcaagagtaatccctaagatacagcctcctacattaggttctgtattaaagaactccatgtgccgtttgcatgcgtcttttaattcctgtgtctcttttccgtataatttttccaggctcggcgccagggtatgcagcaccccggaggcctgcattcgttcatagttgtaggttgaatggctgaagaatgtccagatcagataggacttgatgatatcttttttacttaatctctttttttctatggtttccatgttgattcctccctaacttaaagctgaactttcgctgttctgtaaaagtgctataatcactgctaaaataccgatgaccaccagtggcaggttgatataaatagataaaataaaacctaacagcagatataagtatgcttttgccccagcgttcgataagatagctttaaaattcattgcaataccaagggcaggaagaattgtcccgatcgtagtcaatacatcaatcaccggtgttccctttaatgcctgcagcatgcttgtaataacacctgacccactgtatacggcaattgccaccggaatggtataaatgatgcacttaaaaatctgggaaggaacgatgttatagaaaatgattttctttacatctcctgtctccgcgattttatcggttctatggacaatgaaaatatcccctgtcatataaatcatccataataagttgcccagtaaggaaatcggtactgcaagtgtcactgcgactcctgtagacgcatttgaaatgattgccagtgctgttccgacagttcccgccaggccctcatccatggtctgggcgccgcctgccgtaatctgtgcaagataggttacattgatcgccgcaccgaccatacagcctttgacaggatcgcctaagataagaccaaccaggatcccggatattaaaggccttctcaacgcccagctcatgttaacagtaagccatggtgtcccatttgctcccaaatagtagaccaggccaatcaaaactgcctgtaaaattgaaatatgcatgattctccctccgattaaagtattttatttatctctacagtttccatatttggcacgacctgaatatagacatgtacatgctgtgctgacaattgcttcaacatatctctttcttcatcacttgctgaaatatttttatataatttttttcgttcttgagtagaacccattccgcctaaattgatttcttttacttggacacctttttcaagcaaatccagaaaaaccttgggtccctttgctaaaataataatgtttttatcctcatcttttatcttttctaaatactctgcggcgtcgtcaatagtcattgcctgagcgtttaggtgctttggtactgcacctgtaatgactgcgcttaaaaatggatcctttgcgactttgtcgtcgacgatcacaatttcattccctcccacatgctggacccatgctgtcatgacttgaccgtgaatcaaacggtcatcaatccgtgataatactattttgctcataatgtccctcctctctccatatttaatgataatttagcaattccctgttttccggtctcaacaagataatctgccagctcatccagtttcatatcgtttcttttcaaagctgcttccaccagcatagataaattaattcccgacacacagataacatgtttgtccctgttatgatgaatcgcctgggctgcggcattgtatgggctggcccctaataagtctgtcatgaataagatatcgtgatctgtgcccgcggcgaaagaatcgacccttttgataaaagtatcaatactatcctcatgccgcaatccaagaaaccatatattttcctgcttccctatcataagttccaatgcatcgatcataccttctgcaagtcccccgtgtgtcgccactataatgtctgtcatctacatcctcctttatccgttaaatggtaattcgttctgtatgcgcttacatcacttgggcatatcctaacccacaatctttatatacgcaaattttttatatacacacttgatttacactctatttgagttttttactgtggattttgcataaattttaagtttcgtgtatgataagtgtatattaactacggctgattcaatttgtgtgtgttatagaaacaccgtaatcagcaccaaatatacgcaggagatatggccatgtctacgaacaaagagaagattttatcctatttaaaagaagaaaccttgcaatgcatcaatcatcataattttacctttgaaaaatgtaatgcgcttatcctgtcgatggagttatatattgacaggacaaatgtgtcacgtatcctaaatgatctgcacaaagaaggaaaattaatcaagaaggcaggacgccccaccacttttatttcaagagagatcatccggaactcttttccttttgtatccatccctgatacattgaataaaaatgaaaccatttcagacttcatccgatatgacgtacctgcaaaagaacagaccatcgtccagtcgttttctatggtcggaagtcagcaaaatgggtccttatatgaagctgtaaccagaatcctgcctgtgttttatctccctaaatatttctttaagatcttttttatgcagggggaagctgggacggggaagaagtttttcttagaagaaatgttaaaccgtgcaaaaacgttgggattggctgcccgggaatcatcggtttattatattgaattcagcgatatctacgtcaatctaaggcagagcatagagatgatggaaaaggatcataatatttttatcctggcaatcgagtttgttcaaaaaaacgtagactttgaaatcttaagcggttttgtacattctcttgaaattcaatataaaaataaaaaagacgcgccgatgatcgcctttattggggcatcagaattacagtcggacctgcttcattccatcagtcctgtcatcctgaactttccttccgcaaaagaccggccgcaaacagagttgatttcgattctattgagtatgatccaaaaagagagcaaccgtttagataaaacaatgttggtatcttcccagttcattcagctggttttacataagtgcagcaacctgcatcaattagaaaatgagattttatatacaatttcaaggattctctatacatcaagtactgcaggcaaaaacaatgaacttatgttagatgcatcggtcctgcttgataatgaaagggatgattttataaaatccattcctgaactaaaggcagagatccctgacaagatacagatcagaccaaacggagaaattgattttaataaattgtttcttaactcccatgagcctttggctgaaacaaaaaatatagtttcagattattttacaaagcagctgctgatctgttccagggtgactggcgttgtatctgagaacagttattccggcgataggcttatttcgggcatcacaaaggcattcaataaaagtgtattctgccaggacccatttttaaaagaaaaagtggaacatatgatcctatctgtattccggaaagataaaagtctggatattgtgaaggaaacctcttctatggatattcaaacaccgcagatgaaatcactgttcaacaatctgcttcaattagcacagacaaaccactgcaaactgtcaaaaacccaagaaaaaatgattcaatctatactgacatatgcccacttcatcatgagtgatatccatatacctgtgattattacctccaaatatcatttgctggcaagcaattacgcaaatatcttcaatttattttttgaccggagaatcatacatacctttcctgctgttttatccggaaaaagaaatgagacacgaacgaaccttgagaacttatatgaatttgcggtcagtattaatcgggggcagggggtcctgatcttatcagacgcagatatgaaacaaaccattaccaattacttttttcctaagacgaaggtattgtcttataatgtccagtttcattcctttattctggtgaaagagattttaaggctgtctgtgaagaaaaatgccagcattatttccatcatcccaaatctgttaataagccagaatgatgagataaagatattaaaagacaaccagttaaagagttatactttaagatccgcggataaacatctcttgtttgcgtccaagcttacccccggaatcaatacgtttacaacgaatgaactgtttttccgtgctctgagagcaattgcaaagaagcttgatattaagttaaataacagcctgatcttagaattcctctttcatgcaaattgtatcttatttcagaagaaacatgattttgatttttctaaaaatgtcatggatcacatggatattgattatgctgtcttagaggtcatccagcagaagatacaggagctgtcctcgcctgattttcatgtatctgcatttaccatgaaggattatcagattttgtatgaggctgttttccacagtgcgctgcagggctgatgggagagataaagaatcggttttccgtcttgacattccgcttttgtgtgataaaataaggaatgataaagacagagaaggtgcacagtaaggaagtctttcccgaatttcacaccggagtcgtatccctgaaagaacagtaggggataacgttatctgcacgttacgcaggatactaagagccaggttgtttttgtacctggaattagggtggtaccgcgagatgattcccgtcccttatatataagggatgggatttttttatttccataaaacaaggagaagtgattatgaaggagaaacttgaggcgattaaaaaagaagccttggagaagatcaacacagcagatgccatggacgctctgaatgatatcagggtagcggttctgggcaaaaagggagaattgacccaggtattaaagggcatgaaggatgttgccaaagaagaacgtcctatcgtaggacaaatggtcaacgatacacgtgccgtcatcgaacaggcactggagcaggaaatgtctgttcttaagaaaaagatcatggaagaaaagctcaaaaaggaagtcattgacgtaacgcttccgggaaaggtgcatgaaaagggccaccgccatccgaaccagattgccctggaagacctggagagggtatttatcggaatgggctatgaggttgtggaaggccccgaggtggaatacgataagtataactttgagatgcttaatatcccggagaatcatccggcgaaggatgaacaggataccttctttatctcaaaagatatcttattgagaacacagacatcaccggtacaggcccgtgtgatggagactggtaaaatgccaatccgtatgattgcgcctggaagggtattccgctcagacgaagtggatgctacccactctccgtccttccatcaggtagaaggactggtcgtggacaaaggaatcacctttgcggatctgaaagggacacttgaacagtttgccactgaatttttcggaccggagacaaaagtcaaattccgccctcatcatttcccattcacagagccaagcgcggaggtggatatcacctgctttaagtgtggaggaaagggctgccgtatgtgcaagggaagcggctggatcgagatcttaggctgtggtatggtgcatccaaatgtgctcagggcatgcgggatcgacccagagatttactcaggttttgcctttggaatcggtctggaacgtgtggcgctcctgaaatacgagattgatgatatgcgactgctttatgaaaatgacaagaggtttttaagccagttctaaagcggcaatttccgttcggctcttagaatgcttcactccaatcatatagaaaatgaacgtaatgtcttctggagaagggcctctgtcaaaaaaatgtgctgcttttcgatagttatttaccactattggaggagcgcatttcaaaagcgtgacggaaatagtggtaaataacttataatgattgaaggagaatagagaatgaatacaccaatttcatggatcaaggcatatgtgccggatcttgactgtacgattcaggagtatgtggacaagatgacactttccggatcaaatgtggaatgttatgaggaattagataaaaacctggaaaagatcgtggtaggaaaaattctttccattgaaaagcatccggatgcagacaagctgatcgtctgccaggtggatgtgggaacagagaccatccagatcgtcacaggtgccagcaatgtatcagagggtgatctggtcccagtggttttagtaggaggaagagtggccggaggccacgatggaagcccgaaccctgaaaatggcatcaagatcaaaaaaggaaaattaagaggtgtggcatctttcggtatgatgtgttcagtggaagaactgggaacaaccaaagatatgtatccggaggcaccggaagacggcatttatatatttaagaaggatgtaaaaccgggagatgatgctgtggaggccatgggtcttcgtgaccaggtagtggaatttgagatcacctcaaaccgtgtggactgcttcagtatgatcggcatggcaagagaggtggcagctacatttcacaaagagttccatccgccggtagtaaaagagacaggcaacgatgaggacgtcaatgactatatcaaagtgaccgtaaacgatacagatctttgtccaagatatacagccagagtcgtaaagaatatcaagcttgcaccgtctccggaatggatgcagagaaggcttgcggccatgggtatccgtccgatcaacaatctggtggacatcacgaactatgtgatggaagagtatggacagcctatgcatgcctacgacttagataccatagcgggaaatgagatcattgtgcgcagggccaaggacggtgacaagtttactaccctggacggtgaggagagaaatctggacagcgatgtactcatgatctgcgacggggaaaaggaagtcggacttgccggaatcatgggaggcgagaattccatggtaacggatgatatcaagacattattatttgaagctgcttgctttaatggcaccaatatccgtctttcctccaagagaatcgggcttaggacggacgcttccagcaagtttgaaaaagggcttgatccggaaaatgccatggctgctatggaccgtgcatgccagctgatcgaagaactgggagcaggagaagtgatcggtggagccgtggacgtatatccaaacccaaaacagccggtgtctcttccattggagacggacaaaatcaatgcccttcttggcacaaagatctccatggaagatatgatcgagtacttcagacggattgacgtgaaatatgatgtggataccaacaaactgctgattccgtctttccgccaggatttaaactgcatggcggatctggcagaggaagtggcaagattctacggatatgataacattccggtcactcttccgagaggagaggccaccgcgggtaaaaagccgtttaaaatccgtgtggaggatattgcacgcgactctgtagagaaaaacggattcagcggcggtatgtgctattcttttgaaagtccaaaagtttttgatctgcttctgctgccggaagacgctggggagaggaaagccattaagatttccaatccgctgggagaggatttcagcatcatgcgtacagtttcattaaacggtatgatgacatctttggctaacaattacagccacagaaatcaaaatgtgcgcctgtatgagtttgggaatatctatcttccgaaggaactgccgctcactgagcttccggaggaacggatgcagcttacactaggaatgtacggagactgtgacttctttacactgaaaggggcactggaggatttgtttggagatctgggacttggcggacaggctgaatatgttccggtcaaagaccatccatttatgcatccgggacgccaggccgatgtgctgatcggcggggaaagagcagcatatatcggacagatgcatcctcaggctgttgaaaattatgatatgaagggggaagtctatgtggcagtcatcgatatgccggtgatttgtgagaaggcgacctttgaccgcaaatatacaggcgtggccaagttcccggctatgaagagggatctcagcatggttgtgagaaaagaaatctttgtaggacagattgagaagattttcagggagaaaggcggaaagcttctggaaggctttgaactgtttgacgtctatgagggcgaccagattgacaagggatataaatctgtggcatattcgctgaccttccgtgcccaggacagaacactggaggaagcggaggtcaacaagattgtcgataagattctggatgaattaaaaacattgggaattgagcttagggcataagtaagtcactaggggcaataataagaggagtagaggaagtgcgattactgcagtttttctactcttcttttcatttatgttaaaaatattacaaaatagttacatatattgtgaagatatgatataataccgttgaaaatgtcacaggaggataagaaagaaatgagctatttgaaaggaatgattgaagaaatgcaggaatcagagacaaaaaaaaataaaaagaaaaacatcatcatatgcattctggcgattctgattcttatggcagcggggttcttcggataccgtatctacgcagattataaggaagaacaatttttaaagggtgtaaaattaagagagatcaaggttacgccgaaggtattggaacacaaggaaaaggatgtgtttacagaagcttatcaacaagaatcacaggaacagattgatcaacaaaagaagaaaaattataccatccaaaaacctttggtggtccagaatgcttatgggaccaacactacagctctatattattatggaaagacggaccgcgcatcttatgccgtgtgcaccgtggaggctcccgatgcaggggctgccgtgtacaagcatactttgaaagctaaaaagaaatacagcacaacccatgagtaccagatcgtgggactttcagcgggcacaagaaataaggtgaccatggaattttttaatgaggacaaaagagccattgaaaagcaatatttttatgtggatatcccggaagatgatgtgatacccagaattctgaaaaagaccaggggaagttctgcacaaaagatggaggacggcctgtttgcgctgctcgggcatgacaaggcgcaagacgccaatatttatctctatgacaacaatggagtgaaccggggccggatgcctttgaataaatatcgtacagaccgtctgctctttgtcggagatgacatggcatattcctatgattttaacaagatcgccatggtgaatcggctgggcaaggtcacaaaaacctatgatctgggtgaaagatatgaatttcatcatgactttctgtacgcgaaaaagcagaataaattcatctgtctggtaaacgacaaggaacaggatacgatcgaggatgttgtagtgtccgtagatgtaaggacaggagaggtaaaagagctgatcgactttgaggattactttaagaccatgaggaatctggcctaccgtccgaagaaaaatacttacggcggaacaggcctggactggatccacttaaactccatgaatatgatcgacgacgacagcatgatattcagcagcagagagcagagcacactcattaagatgaaaaatgtgtttgagaaaccggaagtagattatctgatccatggaggtacggtctacaatggaacggactaccagaaatacatgctgaaaaaagaaggtagctttgtgggacaggcagggcagcataccatttcagtggagcatgataaatctcttccaaaaggacagtattacctgtatatgttcaataacaactatggttattccgcaacgatcaaaagctttgactggagtatgtttccggggaccggaacaatgaaggaaggggaaaagtctatgtactacaagtatcttgtggacgaaaacaaaagaacgtataagctggtgcagtcctttgcgatcccttactccccaatcgtcagcagcgtggaacacatgaagaacaacatttctttcggaagcggaacaagcaaaacctttggggaatatgacaaggacggaaagctgatctattcctttggctacgatgcggataagtattcctacagagtgatgaagtataattttgaggggtacttattccgggactaaactaagatatacacaaaactacagatgaaaagaaaaccccggatatgcagaggttatgctgcatatccgggttttgttggagttatgtattttggtttgttttcctagagctggtctttcttttccaggatggcggctacagctgcgcaggcagggcagtcgcagtatttagctccgtttgacttgatctctttggcgtgtgccgcaacatctttcgctttgtctgtcccaaaaacctgagctcctgcttcggactctgcaaaaccgatcaaagtgtcaatgggcataatgtcttcttccaattcggcaatgtatttctttgtctcttcggcttcattttcggtatccacagcattcagccaggcattggcagcctccctggtttcggggctgcaggtaggagaatcaatcagttcgtgggtttttgcaacaacaaaatctaatacatcttttttcataatgggagcctcctcttccgtctggttttgtctttattttactcttgtctcgtggtatttgcaatggcttttaaattgtcgacttcatatggcagtataaagattcagttataactaatataaataattaaatccagttgttttttagttataaatagaatatactattcataataaagtaagaaggggggcaaaaccataatgattaaacgagaactatatatgagtcgcatcaggccttttattggtggtgaactcattaaggtaatgactggtatgcggcgcagtggaaagtcggttatgctggaattaattcagcatgagctgctggtttcaggcgtaaagccggaacaattcatctccattaactttgaagatttgcggtatactcatctactgactgcaaaaaccctgcacgatgaaattatcagaagaacggaggatatcgacggaaaagtctatttattctttgatgagattcaagaagtcaaggactgggaaaagtgcattaactcattccgcgttgcgctggactgcgacatttatatcaccggttctaacgcaaagcttttatctggcgagcttgccacttatcttggaggacggtatgtggaatttgtcatttatccattttctttctctgaatttatggaactgtatcgtaccgtcaagcctgagaactctgttgcccagggatttcagaattatttactatccggcgggatgccatatctcagtaatcttcgctacgaggatgagccgtcccgccaatacctgatggacttatttaactctgtccagctcaaggacatagtgaaacggaacaaggtgagggatgtggacttgctggaacgcatcatcgcctatataatggcaaatgtgggaaacaccttctctgcctcctcgctggtaaagttttttaaaaacgagcaacgtactgtcgctgcagaaactattctgaattatattagatattgtgtggacgcatatcttttttaccaagtgaagcggcaggacctgcaggggaaacagattctgtccaccaacgaaaaatactatatcgcggaccatggtatcagagaggctgtttttggcggaaatatgcgggatattaatctgattttggagaacattgtctatatggagctgctgcgccgcggttacaaagccacagttggcaaggcgggagacaaagagattgattttgtctgtgaaaagcgcggacagaaactctatgttcaggtatgctatcttttggcttctgaggatacgatccagagagaatttggtgcttacgacagtatccgggacaattttcctaaatatgtggtttccatggacgagttcaacatgagccggaatgggatcaaccataaaaatatccgggatttcctaaccgctgaggaatggaattgactaggaataaaaaacaggatgtatcaaaaactaagatatatcctgttttactattttatataattcctattgaataaacatggcatctccaaagctgaaaaagcggtaccgttctctaacggcttcttcgtaggcggcaagaatatgttctttgcctgccaatgcagaaacaagcatcagaagtgtagattccggaagatggaagttggtgatcagggcatcaatcactttaaactcataccccggatagataaagatatcggtccatccactcttgggctcgatatgcccgtccacatccgccacggactctagcgtcctggtgctggtagttccaacggagatgatccgtccgccttccttccgggtttggttgatcgcctgggccgctgtttcatccacagaatagaattctgagtgcatgtgatgatccgtcacgtcttctacctttaccggacggaatgtgcccagtcccacatgcagggtgacgtaggcaagccttacccctttttcttcgatctctttcagaagttctttagtaaaatgcaggccggctgtaggtgctgccgcggatccctcgtgcttggcgtagaccgtctggtaccggtttttatcctcaagctgatgtgtgatgtatggagggagaggcatctgtccgagctcgtccagcacctcttcaaagattccctcaaactcaaaacgaaccagccggtttccttcatctacaatgtcagtgacttcgcctacaagccttccgccgccgaacgagatcctggttccgggtttcgcttttcgccccggctttacaagagtttcccagacattgtcctgtcttcgttttagcagcaagacctcgattttagctccggttccctctttttctccgatcagacgggccggtaggaccttggtgtcatttaatacgagacagtccccttttttcaggtaactgaccacgtttttaaagacctcatgtatgatctccccggtttctttgtccaatactaataatcttgagcttgaacggtcagccaggggatcctgtgcgatcagttcctccggcagttcaaacgtaaaatctgatgttttcataaatgctcctgctttcttataattctttcaaacagtatagcattaatgataaagtccggcaatgcctcaagagaacggaattcaggttaggaatttaaagatatgcaattgcttaaaatattccgatactatataataaaacaaggctgccaggacgtataaataagatttataattgtgccttgtttagagattatctataaacaaatctcaggaaaatgtggcagcattcagtgtataatggaggtatcaatgcgagtagatttgacgaatggcaggatcggccgttccatcattttattcagccttcctatgatcctgggcaatctgcttcagcagctgtataatgttgccgatacgctcattgtcggaaggacgatcggggctgcggctctgtcagcggtgggatcggcttatgcgctgatggtgctgctgacgtcgatccttttgggactctgcatgggcagcggggtggtatttgcccagttgtacgggcgcagggaggaagaccggatgaagacagcggtggtcaatgcctttgtctttatttttgcagtggccgctgtaatcacggggcttgcgtttctgcttctggatgagattattctttggcttcatattcctccggaagcggctccttttacccgggaatatttgtttattatctttttcgggatattttttgtctgcatctataacttttttagcagtgtactgcgcggtatcggaaatacagtggcgcctctgatgtttcttgctgtttccgcagtcctgaatatcatattggacatggtatttatcttaaaattcggaatggggattgcaggggcggcatgggctaccgtcattgcccagggggtatccgcagccctgattacggtctatttttttgtaaaagaaggggaattgtgccccaagcgctgtcatatgtactacagccgggagcttttgggaatgatcatcaataactccactttgacagccatacaacagtctatcatgaatcttggaattttgatggtgcagggattggtcaacagctttggattcttaacctctgcagcctttgcagcagtagtaaagattgatgcctttgcctatatgccggcacaggatttcggcaatgcgtttaccacgtacattgcgcagaattatggagcgggaaaacctgaccgtatcaaaaatggtctccgcttggcagtggggatctctgtctgtttttgtgtcgctgcatctatgattgtggtggcgtttgccaggcagcttatgctgatcttcatcaaaccgcaggagacggagatcattgccatcggggtaaagtatcttcatatcgtcggctgtttttatgcgggcatcgggattttatttctgctctacggactttaccggggcctgggccgttctgcggtttccatctggctgacggtcatctccctggggagcagagttctgttagcctacgctttgtcagctgtgcctgccataggcctgattgggatctggtgggcggttcccatcggatgggctttagcggatgtgttcgggcttatgtattttggctgccgaaagaaacggcttttgttggaatgtaaacaatcttaaagatataaaggagttttatgagtcaagtaatcgtagttggaggaggggcggcaggaatgatggctgccatctgttccgcgaaagaaggcaatcaggttgtcttattagaaaaaaatgaaaagctggggaaaaagctttttatcacaggaaaaggaagatgtaacctgaccaatgccggtgatatcgaagatctgatgggccatgtggtcacaaaccgggagtttttatacagtgcgttttattccttcaccaatgagcagatgatggaatggatggagcattggggatgtccggtaaaggtggagcggggaaaccgcgtattccccgtgtccgacaagtcctcagatgtgatccgcgctatggagagagagcttcgcagacagaaggtcactgtagaactgaatacggaggtacgccgtatcctgacagagggcggaagaaccagcggcgttgaactgaaaggctcaggaaccctgaaagcggataaggtggtcattgccaccggaggcatgtcctacccttccacgggttccacaggagacggatatggatttgcaaagaaagccggacacaaggtgatgcatttagatccggcgctggttccgtttaatatagacgggacagtctgttcaaggcttcaggggctttcccttaaaaatgtggaagcatcgctttatgcagacggaaaacgtatttataaggagttcggggagatgctgtttactcattttggcatcagcggaccgatcatcataagcgccagcagctatgcagtgagatacagaggaaaacagttaaaattttgtatcgatctgaagccggcattgtcggaagaacagctggatcagagaattctgaaagattttcaggaaaatatcaataaagaattcaaaaattctctcggaaagctgttgccaaaaaaaatgatcccggttatcctagaactatcgggaattccggaggaaaaaaaggtccatgagatcacaaagaatgagcggaggaagcttactgcgctgctgaaggccgtgccgcttattgtcacaggcacgagaggctttaaagaagccatcatcacccacggcggagtggacgtaaaagagattaacccgagcaccatggaatccaggaaggtgcggggattatattttgcaggagaagttttggatttggacgcgctgaccggaggatacaatctccagatcgcatggtccacaggatacctggcaggaatgaattaggaggaaatatcatatgtacagcattgctattgacgggccggcgggagccggaaaaagcacgatcgcaaaaaccatcgcaaaaaaattagagtttatctatgtggatacgggggccatgtaccgggctatggctttgtttttcatccgcagcaagatcgatgatacggatgaagcggtcatcgacgctgcatgcaaaaatatcaaagtcagcattgcctatgagaacgggatgcagcaggttattttaaacggagagaatgttaccggccagatccgggcggaagaagtagggaatatggcgtcaaagacatccgcatatccgtctgtgagggctgcgcttttagatctccagagagaccttgcaaagactgcggatatcctcatggacggaagggatatcgggaccaatgtgcttccggatgcggatttaaaaatatatttgacggcttccgtggaggtcagggcaaagcgccgctatgatgaactgatcgaaaaagggcaggaggcagatcttgctgtcattgaagaagacattaagaaaagggatcaccaggatatgaccagagatatcgcaccgcttaaacaggcggaggatgcggttcttgtggattcttccgggatgacgatcgaagaagtggtcgatacggtgatccgggaatttgaaaaggtgaaataagagatggaagtaaacttggcgaaaactgcaggattttgtttcggtgtcagacgcgcggtggataaagtctatgaggaagcagggaaagaacaggtctatacatacggaccgatcatccacaactcggaggtagtctccgatctggaacaaagaggcataaaagttctccattccagagaagaactggagaagatttcagagggcactgtgatcatccggtcccacggcgtggcaaaggacatttatgagctgatccggcagaaggggctgcatctggtagacgccacctgtccctttgtcttaaagatccacaggatcgtggagaaggccagtgccgagggaaaacagatcctgatcatcggcagtgcggaacatcccgaggtagaaggaatcaggggctggtgcagcaaagatgtccatgtgatctccgatgcagaagggctttcggagatcgatctcggctgcaaaccgacctgcgttgtttcacagacgacatttaattacaataaatttcaagatatagttgaaattatcaaggaaaagagttatcatatagaagtatgtaatacaatttgtaatgccacagaagagcgtcaactggaagcaaaatctatagcacacgatgtagatgcaatgattgtcattggcgacagacaaagttctaacagccagaaattatatgagatcagcaagaaagagtgtgggaacaccttttttgtgcagacacttaaagacctggatttgaaactttttgaatcgactggtaaggtaggtattacagcgggggcatccaccccagagaaaattatcaaggaggttcatgctagcatgacggaaaagagttttgaacaattattagaggaaagtttagttacgattcgtaacggagaggtagtggaaggaacagtcattgacgtaaaaccagatgagatcatcttaaacatcggttacaaagctgacggtattctgacacgcagtgagtactctaatgatgcggctaacttagatttaacaacgatcgccaaagtaggggatacgatggagacaaaagtccttaaagtgaacgacggagaaggacaagtgttgttgacatataagagactggcagcagaaaaaggcaacaagcgtctggaagaagcttacgaaaacaaggaagtgctcaaagcgcctgtggctcaggttttagatggtggtttaagtgtgattatcgatgaggcgagagtcttcatccctgcaagccttgtatctgattcttacgagagagacttaaagaaatatgacggacaggaaatcgagtttgtcatcagtgagtttaacccgagaaagagaagagtcatcggagaccgcaagcagttgttagtggctgcaaagaaagaaaaacagaaagaattatttgaaaagatcgagcctggaatgaagatcgacggagttgtcaagaacgtgacagacttcggtgcgttcatagatttaggcggtgcagacggactgcttcatatctctgagatgtcctggggacgtgtagagaatcctaaaaaggtattttctatcggagataaggttacggtactgatcaaggatatccagggtgagaagatcgcgttaagcctgaaattccctgaagagaatccatggttaaaggcagaagagaaatataaagttggcaacgttgtggacggaaaagttgcgcgtatgactgatttcggagcatttgttgagttagaatcaggcattgatgctctgcttcacgtatctcagattgccaaggaacatattgacaagccatctgatgttttatccgttggacaggaaatcacagccaaagtcgttgacttcaaaaaggatgaaaagaagatcagcttgagcatgaaagcattgatcactgacaatgcagatgatgcagaataagagattgacggggcggtttccgatgcaggaaaccgtctttttttgacctgccaggggttcccgtcaatccgctattgtaatatggctgattttaagctataatgttttctaatacgtcttgctgtggcggatcattgtcctgccaggaaagacaaattttatataaggagtagtttaccaatgcaaataaagaaatttaaaaaagtattagtagccaaccgcggtgagattgcgatccgtatattccgtgctctcaatgagttaggtattaccactgttggcgtattttcaaaagaagaccgctatgcattgttccgctccaaggcggatgagtcatatcagctgaatccggataaaggaccgatcgatgcgtatctggatatcaagaccatcatccggattgccaaagagaaaaatgttgatgcgatccatccgggatacggattcctgtctgaaaatccggaatttgtagatgcctgtgagagacacggtattacctttattggaccgacatctgacattatgagggcgatgggagataaaatctcttccaagcagatggcaatccaagcggatgtgccgatcattccgggtgtggaccatgcggtacatagtgaaaaagaagtcattgagatcgcagagaaggtcggataccctgtgatgctgaaagcatccaacggaggcggcggacgcggcatgcgcatcgttcacacggcagaagatatgccgaaggaatatgcggaagcaagggatgaatccaaaaaggcattcggagacgaccagatttttattgaaaagtatcttaaaagtccgaagcatattgaagtacagatcatcggagataactacggtaatgtagtccacctgtatgaccgtgactgttctgtgcagcggcgtcaccagaaggtggtagagtatgcaccagccttcagtattccggaagagacaaggcaggttatatttgacagttctttaaggctggcaaagacggtcgggtaccgcaacgccggaacgttagagttccttgtggacgccgacaacaatccttacttcatcgagatgaatccgaggatccaggtagaacacacggtgacagaaatggtgacagggatcgatattgtacagacacagatcctcgttgctcaggggtatacccttgactctgatgagatccagattccttctcaggaaagtgtggaaactacgggctatgctattcagacacgtattaccaccgaagatccgtcaaacaacttcctgccggatacaggaaagatcacggtataccgttccggagcaggaaatggaatccgtctggacggaggaaatgcttatgcaggggcagagatcactccatattatgacagcctccttgtaaaggcatgttctcatgaccgtacgttcttaggggctgtgatgaagtctacccgtgtgctgaaagagacgagaatccggggcatcaagacaaatatcccgttcctgattaatgtccttaaccatgagacctttaaatcaggagagtgctatacgacatttatagaagatactcctgagctgtttcttttcgccgcatcccaggaccgtgccacaaagatcctggagttcctcggaaataaaatggtcaatgaacagaaggcagaagaaaaaccgttcttcgaagaccgcgtgcttcccaaatatgacaagaagaaagagatttacggcgcccgcgatgaattcttaaaactcggagccgaaggttatactcagaagatcttaaacgataaaaaactttatgtgactgatacaacgatgagagatgcccagcagtctctgatggcaacccgtatgagaacaaaggatcttgcaggtgctgccaaggcgtccaaccagtacatggcaaacgcattttccatggaagcgtggggaggagccacatacgatacttcttaccgcttcttaaaggaatctccgtgggtaaggctggcactcttaagagaaagaatgccgaataccctgatccagatgcttcttcgggcatccaatgcggtcggatacaagaattatccggacaatgtagtgacgacttttatcgaagaggcagcatctcgcggagtcgatgtattccgtatttttgacagcttaaactgggtcgagaatatgaagcttccgatcgagacggcattaaagaccggaaagatcgtggaaggagctatctgttataccggggatattctgaatccggatgagacaaaatatacgctggactactatgtgaaaaaggcgaaagaactggaaagcctgggatgccacatctttaccatcaaggatatggccggacttgtgaagccgtatgcggccgaaaagctgatcagaacgctgaaagaagaactgaacataccggtcaacctgcacacccatgattctaccggaaacggagtcagtactctgctgaaagctgcggaagcgggagtggatattgttgactgtgccatcggttctatgagctccatgacaagcaacccgtctatgaactctctcgcagaggctctcaggggaagcgagagggatacaggattaattccggatgaactcacagaattaagccagtactatgagagactgagaccggtttataaacagtttgaaagcggcatggacgctccgaatacagagatctacaagtatgagattccgggaggacagtactcaaacctgctggctcaggtaaaagagatgggagccgcggaggattttgaagagatcaagagtctgtacaaagacgccaatgatctgcttggaaatatcgtgaaggttacgccttcttctaaagtcgtgggagactttgccatctttatgtttaaaaacggcctgaccaaagaaaatatcctgacagagggcaaaggcttatcttatcctgattcagtggtcgaatattttgaaggcatgatcggacagccggaaggcggattcccgaaggaacttcaggatattgtgctgaaaggcaaagaaccgatcaccgtccgtccgggaagcctgattcctccggaagacttcgaccagatcaagaaagggctcaaggagttcttctatgttgatacaatggaagacgaaaagacgctccaccgcaaagccatcagttatgctatgtatccgaaagtatatgaggattactgcagacattttgaggcatacaatgatgtcacaaggctggaaagccatgtgtatttctacgggctgagaaagggtgaggagaccacactgaccatcggagaaggaaaagacctgatcatcaaatttgtggatatgtcagaaccggatgagaacggataccgtctgctggaattcgaggtcaacggttccatgcgtgaggtgaagatcttagaccgcaacctggaagtcaaggcagaccacaggatcaaggcggataagagcaattcggcacatttaggctcaacaatcccgggaaccgtcggaaaagtcctcgtaaaagagggagatccggtaactgtgaacatgccgctgcttaccgtggaagcgatgaagatggaaacaactgtcgtatccaaggtcaacggcaaggtagataagatctacgtcaaagaaggcgaacaggttaatcaggaagatctgcttgtatcttttgaaatcgaagaagaataatctttctcattatgacagacaataaaagggagaagcactgcgcttcttcctttttttattaaatcaaagtgaggatgtcgatatgaatgaagatcaaagaaatgaaataaaagatatcggagaattggatttgggcggtatccacgtgatgacggtcattggagagatcgaggggcaccagctgtcagcccagaattccaagacaaccaaatatgagcatatgatcccggcgctggcaagagcagagtattctgatgatatcaaaggaatcctgatcctgatcaatacggtcggaggcgatgtggaatgcggtctggcgctcgcagagatgatcgcttctctgagcaaacccacagtaactcttgtattgggaggaagccattccatcggtgtgccccttgcagtctcttccgactattcttttattgttaaaagtgcaacaatgatgatccacccagtgcggtccggcggtacttttatcggtgtgcttcagagctaccgcaatattgagaagatccaggaccgcattacaaggtttatcagcgaccactctgatatcacaaaagacaaggtagaagagctgatgctccacatcggagagcaggtgaaggacgcagggaccatattggagggagaacaggcggtggagctgggtctcatcaatgaaatcggaggcatgagcgaagcctttgcaaagcttcaggaactcgtacaaaatacctcggaaaactgagagaaaaccgggggtttcggtgtacagaataaagtacaaaaaaagcaaaaaaatcctttaatttcggataaaagtagtgtagaatgataatagattgtttttattttaacgaacattaaaggaggagctatgagaggaattgagaccccggtccgagagatcagaaaaaaggtatttacagagattgctaaatttgcctatgaacaaagagaccttgaagaaattgaggatctgccgtacgaattagtgaaaggtgagctgccgacataccgcgacagtatttatcgtgaaagggcagtggtaggagagagaatccgtcttgccatggggatgtctttaagacctgctgataagcctgcaagaataacaaaaggaatcaaacagagcaacattgcggaaaaatactacgagccgccgcttttgcaggtgatcccggcagcgtgcaacgcctgcaaggacagagcattcatcgtaggaggagagtgtcagggatgtatggcacatccatgtatggaagtatgtccgaaaaatgccatcagctttgtggacggatattcctacatcgatcaggaaaagtgcattaagtgcggacagtgccagaaggtttgcccatacagtgcgatccatgagagaaaaagaccgtgtgaagttgcctgtggcgtgggagcgatcgaaaccgactatgccggacgcgctaccatcaatccggacaagtgtgtatcctgcggtatgtgcatggtcaactgtccgtttggagccatcgcagacaagtcacagatctatcagctgatcaaagccatgaatgagggcaacgaagtcatcgccatcctggcccctgcttttgttggtcagtttggaccgaaggcaacacctgccaaggtgaaggccgcactgctggacatcggatttgccgatgtatgggaagtggcagtgggagcggatgcaggtgctctggaagaagcggatcactatgcacatggagttgtcacaggagaggtgccgttccttttgacctcctgctgtccgtcttggtctatgctcgggaaaaagtacttccctgaactgatcgaccagatatcaaattcactcaccccgatggtggcaacagccagagctgcaagacagaccaacaagaatgcaaagatcgtgttcgtcggcccttgtgtggctaaaaaactggaagcttccaggaaatctgtcagaagtgaagtggacttcgtcattacatttgaagaattggacggcatgtttaccgccaaggatattgatttcagtacttacgacaaagaagtcgagatgaacgatgcgttcggtgcaggacgcggatatgcagttgcaagcggtgttgccgcggctatcgaagcatgtgtgaaagaataccatccgggagtagatgtgaagattgaccacgtggaaggactcgcagagtgcaagaagatgctccttcaggcaaaagccggcaagaagaacggctacctgatcgaaggaatgggatgcccgggagggtgcgttgccggagccggaaccaatatcccggtagtcaaagcgggtgtacaggttaaaaagttcgtgaatgaagcagagcagttcattccgcctgagacagcaaaatactgatattcattatatttcagagatacaaaagagtctgaacggaaccaaagagttctgcccaggctctttacatttatttaggttaattgtaaaataggcatataactcttttgataaagggttgttgagcattaaatataagaagaaaagagattccagaagaatggcagcaaaaaaaagaaagagaagaaacacagcacgaaagaagaaaaagcaaaaagactttgcaggcttctatcaggaaattgcggttctgttaagttttgcagtttgtctttttttatttttgagtaatttcagactctgcggaaaagtgggaaacacggtaagttctgcgctgttcggagtgctgggcggtgttcactatgctgctcctattgttatattgatcatgatccttctgctgatctccaatcagtacagcagcatctcggtaaagaagtctttttttattgttctgctcctgtgtatgactgcggcgatatggcagatggcgacagacatccgtatgtctgatgcagcagtgctgtaccggtacggatcggaacatcatgcgggaggcggagtggtcggaggtgtcatcgcttcttttctgtataaggagctgggactggcaggaagttatgttgtcgtattttttttgacagcaatttctatgatactgattaccgagagatcactgctctcctttgtaaagcgtgtggcagcattttttgcacccgaacggacttcaggaaagaagaccaaaacagctgataagagaaagccaaaagaaaaagaggacaggcaggcatcaggaatcaagactccaaagctcccagacttaaagctgaaaatgagagagaaacagtcaaaggtactggatgaccttactctgatgccggaagagccggcaaaagaaccggacaagccgtttgatctggacgagatgatcggacagcccgatgaggaagtactgccggaggagccggagctgaagccgggcaaaagatcttttgtgaacagagagaaatcagagcctgaacctattccggagatttccatacatccttctgcgctggaggagggagattatgtgtttccgccggtgactctgctgaaaaagggaaagaaggccggaggaaacagtcaggcagaacttaaaaagacagccctgaagctggagcagacgctgagaaacttcggcgtcaatgtgacgattacggacatcagctgcgggccgtctgttaccaggtttgaacttcagccggagcagggagtaaaggtcagcaagatcgtcgggctttccgatgatattaaactgaatctggcggccccggacatacggatcgaagctccgattccgggaaaggcagcagtgggcatcgaagtgccgaataagaccaatcaggtggtcatgttccgggatctgattgaaaataatgactttaaacgcttctcttccaatatcgcgtttgcggtaggaaagaatctggctggcaaggtgattatctcagacattgcaaagatgccgcaccttttgattgcaggtgccacaggttccgggaaatcagtgtgtatcaatacgctgatcatgagtattttatataaagcaagtcccaacgatgtgaagctgatcatgatcgatcccaaagtcgtggaactgagtacatatcagggaatcccgcatcttctcatcccggtggtcacagatcccaagcaggcatccagcgcgcttaactgggcagttatggagatgggagaccgctataagaagtttgcggacgtcaatgtaagaaatctgaccggatataatgaaaaagtaaaagagatgaaggaaaagggaatggaaggtgaagacttccagccgctgcctcagatcgtcattattgtggatgagcttgcggaccttatgatggttgcgccgggtgaggtagaggatgcgatcgtaaggctttctcagcttgccagagcggcaggcatccatctgatcattgccacccagagaccgtctgtcaatgtcatcacaggactgatcaaggctaatgtcccttcaaggatcgcattttctgtgtcctccggggtggattcccgcacgatcattgacatgaacggagcagagaagctcttaggaaaaggagatatgctcttttatccggcaggataccagaagccggtccgggtccagggagcatttatcagcgatgaggaagtgggacgtgtcgtagacttcttaaagagccagaacatagaagatgactacggcagtgagatcaaagaaaaaatcgagacggccagtgtgaaggcatcggtttcggcagacagagacgaatattttgaagatgcggccaaatttatcatagataaggacaaagcatccattgcaagccttcagaggatttttaagatcggattcaacagggcggcaaggctgatggaccagctctgtgaagccgggatcgtcggagaagaggaaggtacaaagccccgtaaggttctcatgagccaggaagaatttgaacaatacaaagaggaatatttatagaagaaaggaatccaaccaatgaaaacagacattcagattgcacaggaagcagagttacagccaatcagggaagtagcggcgtctcttgggatcagtgaagacgatcttgagctgtacggcaaatataaagcgaagctgtcttccggattcatgaacgaaatcaaggatcgtgaggacgggaagcttgtacttgtgacggcgatcaatccgactccggcaggagaaggaaaaactacgaccagcattggtctcgcacagggactcacaaagctcgggaagaaaacggtggctgcgttaagagaaccttctctcggaccgtgcttcgggatcaaaggaggtgctgccggaggcggatatgcccaggtggtgccgatggaagacttaaatcttcactttaccggtgactttcatgccatcacttccgcaaataatcttttggcagccatgattgacaatcatattcagcagggaaatgcactgaggatcgatacgagagacatcgtctggaaacgatgcctggatatgaatgacagggcactgagaaatattgtcgtgggattgggaagaaaagtggacggagttgtccgtgaagatcactttgtgatcacggtggcctccgagattatggcaattctctgccttgcaaatgacatggaagatctgaagaaacgtttaggcaagatcattgttgcctataatatggataaagaacctgtgacagcagcggaattaaatgctgtgggagccatggcggccctcttaaaggatgccttaaagccgaacctgatccagacgctggaacatacgccggcctttgtacacggcggtccttttgcaaacatcgctcatggctgcaacagtgtccaggctacgaagatggctttaaagctttccgacatcactgtcacggaagcaggattcggagcggaccttggagccgagaagtttttggatatcaaatgtccgatggcaggactctctccggatgcggttgtcctggtagcaacggtcagggctcttaaatataacggcggcgtttccaaagaagatctggggagggaagatatcgacgccctgagcagaggtattgtaaatctggaaaagcatatttccaacctgaagcagtatggggtgcctgtggttgtcacactgaaccggtttgtcacagacacggaggctgagctggactttatcaaacatttctgcgaggagagagactgtgattttgccctgtcagaggtatgggaaaaaggcggagacggcggcattgagcttggaaaggcagttctcaggacgttagagacgaaaaaaagcgagtaccgcccgctgtattcttacgaggatacttccattgaagagaagattgagacgatcgccacaaagatttatggtgcggacaatgtaatctatgcaccggcggcagccagacagaaaaagcagcttacggaacttggctacggaaatcttccggtctgcatggcgaaaaaccagtattctttatctgatgacccgaaaaagcttggccgtccggaaaattttgatattacgatccgcgaaatctatgtaaatgcaggagccggatttgttgtagcgctgaccggagatatcatgaccatgccggggcttccgaaaaagccggcggcagaaggcattgacgtaaacgaagacggtgagatcaccggtttattctaggagtgacgagaggaaacagacatgacacagataatagatggaaaaaagatctcagcggagatcaaagacgagttaaagcaggaagtagcagccatgaaagcagagggaaaagagattgctctggcagtgatccaggtaggtgaagatcctgcatcctctgtctatgtgaggaataagaaaaaagcatgcgaatatattgggattacttctgtatcttatgagataccggaagattccacccagcaggaactgcttgacctggtggaaaagtgcaacaaagatccaaagatcaacgggattttagtccagcttcctctgccgccgcatatggatgaggacgcagtgatccatgccattgatccgaaaaaggacgtagatgggtttcatccggtcagcgtgggaaatatggtgattggaaatgacggatttcttccgtgcactccggccggcattatagaactcctgaagcggtccggtgtggagatcggcggaaaagaatgtgtcgtcgtgggaagaagcaatattgtaggcaaacctatgtccatgctgctgctcagagaaaacggtaccgtgaccgtctgccattccaggacgaggaatctgcgggaagtatgcagccgcgcggatatcctggtagtagctgtcggaaggcctaaattcattgatgcatcttatgtcaaagaaggggctgtcattatcgatgtgggtattcacagaaatgaaaataacaagctgtgcggagacgtggattttgacgcagtgaaggaaaagacatctgcgatcactccggtgccgggcggcgttggaccgatgacgatcgctatgctgatgaaaaactgtgtacagtcaaaaaaattgtttggagaataacagatgaaaatactttttatttctcttggatgtgataaaaatcttgtagacagtgaggtgatgctgggactgctcacagagagaggacacactttgacgaacgacgaggaagaggcggatgtgatcgtcatcaacacatgctgtttcattcatgacgccaaggaagagagcattaatacgatccttgagatggcagcttataaagagcagaatctgaaagctctcgtggtcgcaggatgtctgtctgagcgctataaagacgagatactggaggagattccggaaattgatgcggtgctcgggactaccagttacgattctattgtcgaggcagtggatgaggctcttgcgggcaatgactatgtacattatgagagcatcaattatcttccggataattccggacaccggcgtctggtcacgaccggaagccatatggcttatttaaagattgccgagggatgtgacaagaggtgcagctactgtatcattccgaagatccgggggaggtttcggagtgttccgatgaaggaactgttaaagagcgctcgggagctggcagcatccggtgtgacagagctggtcctggtagctcaggagacgacgctgtacggaaacgatcttaccggtaaaaaggagcttcccgttctgctgagagaactttgtaagatcgagggaataaaatggatacgcctgctgtactgttatcccgaggagatcaccgatgagctgatccggacgataaaggaagaagaaaagattgcaaactatattgatatgccgattcagcactgcagtgacgggattttaaagcggatgggccgcaggacatctaagaaggacatcgaaacgatcatcgcgaagcttaggaatgaaataccggacattgcgattcgtacaacgcttatcaccggttttccaggcgagacagaagaacagcacgaagaactgaaggggtttgtgaggcagcagcgctttgagcgcctgggagtctttacttattctccggaggaggatacaaaggcagcagaatttgaagggcagatagaagaagaggtgaaggaagccagaagggatgaactgatggcccttcagcagcagatttcctgcgaacatactcaggggatggttggaaaaactatcagggtactgatcgaaggatatctgtttgaggacgatgtgtatgtgggccgcagctatatggatgcaccaaaagtggacggatgtgtctttgtgacttcaccggaagaactgctgaccggagactatgtttatgtgaaaattaccaaaggaaatgagtacgatttgataggagagatggactatgaatttacccaataaactaacgatattgagagtattgatgataccgatttttatttttgtactgctggcggaaccgtttggtgagatcagcaagtggattgccgtggccatttttatcattgcaagcctcacggactttctggacggacatatcgcgaggaagtataatcttgtgactaattttgggaaatttatggaccctttggcagataagcttttggtctgctctgccatgattgctctcgtgggaatgaaccgcctggcatcatggatcgcaatcattattattgccagagaatttattatcagcggtttccgtctgattgcatcagacaacggtgtggtaattgcagccagctattggggcaaattcaaaaccaattttcagatgtttatgatcatcatgctgatcatcgacctgggaaccggcacagcggtgcttattgaaaatattttagtatacatttcgcttgtgttgaccatcatatcattgttggattatttattaaaaaacaagaatgtcttgaaatagaaggagacaattatgacagcagaaattatttgtgtgggaacagaaatattattaggcaacattgtcaacaccaatgctgcctacctgtcagaacgcttagccgcccttgggataagcgttttttttgagaccactgtgggtgacaatccaaagcgtgtggaagaagtgattcggacaggaatgaaacggtcggatatcttgatcttgtcaggggggctcgggcctacgaaggatgacctgacaaaagagattgcggcaaaagcatgcggacaggaacttgtggaagatgcagaggcgaaggagcggctcacttcctactttacgagcatcaaacgcccgatgacggaaaacaatttaaaacaggccatggtgccggaagactgtactgttttatacaacaaaaacggcacagcgcccggtatggtgatcaacgcaccggaagacaagaagattatcctgctgccgggacctccaggtgagctgatcccgatgtttcatgagcaggcagaaccgattctttcccgacttcagcctggtatcttatattccaaggttgtcaagatcgactgcctgggagaaagctatgtggaaacccagatcatggacctgatcgatgaacagagcaatccgacggtggcaccgtatgcaaaattaggagaagtgcatttgagggtgacggccaaggctgactctgaagatgaggcaaaggaacttgtcatgcctatggtggaagaactgaaatcaagatttggggataagatttataccattgaggaagacgaaacactggaggaagtggtcgtaaagatgcttgagagcaggggcgataagatcgcctgtgccgagtcctgtaccggcggcctgctggccggaaggctgatcaatgttcccggggcgtcaaatgtgctggaagaaagttttattacttactccaatgaagctaaaaagaagtatcttggtgtaaaagaggacactctgaaagcccacggggcggtatcggaagaaactgcccgggaaatggcggaaggcgtcttaagagcttcaggagccgacatcggtgtggggattaccggacttgccggtccgggaggagagaccggaacaaagaaaccggggctggtctatatcggagtcagcagaaagggaaatactgttgtgaagaagtatgatctgagaggaaaccgcgccaagatcagagaagtttctgtgtgcagggcactgacgatgatacggaaagcgctgtcagagtgattgtaaaacatgtaaaaatatgttaaaataaaagagaaaaacaagtacgaacaaatattcgccgaacacttgtttttctctttgtgctatgatataatcaaaaacagttcataataagataaaaggagaatacagatgcaacagacagagaagttaaaggcattggatgcagctcttacgaagatagagaaagattacggcaaaggagccgtgatgaaacttggagaataccaggcagacatgagcattgagactacaccgacaggatctctgagcctggatatcgctctcggagtcggaggtataccgaggggaagggtgatcgagatttacggtccggagtcaagcggtaagacaacggtcgcattacatatggtggcagaagtgcagaagcggggcggcattgcagggtttatagatgcagagcatgctctcgacccggtctatgcgcagaatatcggagtggatgtggacaacctctatatttctcagccggataccggagagcagggacttgagatcgccgagactatggtgcgttccggcgctgtggatatcattatcgtcgattctgtcgcagcattggtgccaaaggcagagatcgacggagacatgggagattcccatgtgggcctccaggcaagactcatgtcacaggctctgagaaaactgacggctatcatcagtaagtccaactgtaccgtgatctttatcaaccagctgagagaaaaagtcggagtcatgttcggaaatcccgagacaacgaccggaggccgtgctctgaagttctattcttccatccgtctggacgtacggcgtatcgagacactgaagcaggccggggacatggtaggaaaccgtacccgtatcaaagtagtaaagaataaggttgctccgccgtttaaacaggcagagttcgatatcatgttcggtgaaggcatctccaaagaaggcgatattctggatctggcagccggcgtggatgtgatcaaaaagagcggtgcatggtatgcatatcagggcgaaaagatcggacagggaagagagaatgccaagacatacttaaaagaacatccggaagtagctcaggaagtggagtccgcagtccgcagggaatacggactggaagcaggaacagaggacgccgcaccggcagaagaaaagccggatacaaatcagcagtaagcgtcggatatgagagtgacgatgctggagccggtgggaaagaagcagatcagactttatctggaggatgagcggtattgtcttttatatgcgggggaggccaggcggcttggcctgaaagaagacatggacttatccgaagtacagaagaacgaactggacagcatgctcctcagccgggccaaattaaaggcgatgaatcttttaaaagtctctgaccggacaaaggaagagatcaggatgaggctcaggcgtctggaactgcctgaatcctgtatagaaggagcggtatcctatgtggaaggataccactatatagacgatgaagcctatgtgaggaattatatcgggtaccggggtttttcaaagagccgcctgaaactcagacaggaattgttgaagaaggggataagcccggagctgtttgaacaaatttgggaagagtctgctgtctcagagtcagatattctgagaacacagataaaaaaaagaattcggcagaaaggaccggtaacagaggaaaatttccagaagaatctggctttctttgccagaaagggattttcaattcatgacattttagaaattcttaaggaatataaagagtaattcagttgatttttctagaaaacgggatataataagattagaaccagagttacatgtcaagttctttaaggagatcgaatgagaaaaaaatcacacatttcattggctggacaaattatggactcactgagactggaagaagtttttgactataagttaccgttttatgtcgggagtatctggccggactgcagaccatcctttttgacaacaccgcatacttttgacataacatatgataaaatagagaatcaacttgatgactttgtagcagactacgataccctgaaggggatgaacatgcgccgctgtgcaaagttgggagtgattattcattatattgctgattactttacgtttccccacaacagcacttacgagggcaatgtaaaagaccattgtatttatgagagggatttaaaacacggactcaaagagtatctctccacagaagaagccatggagcgcaaagacaagattgttccgttgagttctacaaaaggtttgtctgaattcattcagaacatccatgcagaatatatgcgcggtgaacacagcgtggcagatgatatcaagtacattgtggatgtgtgcaccacagtagtgatgagcatattaaatattattaagatcagctacgagaatgttgctctgaaagtacagtacgcataagcagaagaatttataccgcaggctagcttttatgaaaagttatcctgcggcatttttttgtggaagaaggaaataattaataaataagaaaggagatcagaggtatgagattaaaagataaagtaatcttgattacagcttcaacgagggggattggtctggcgataacgaaagcgtgtgccgaagaaggtgccattgtatatatgggggccagaaacctggaacgagcggggcagagagcggatgagctgaatcagaagggctttcgagtaaggtatgtgtataatgatgcctatgaaccggagacttacgacagtatgattgaggaagtggtcaataaggaagggcgtatcgatgtgcttgtaaacaatttcggcacttcagatccgaagaaagacatggatatcggccatacggactgcatagacttccttcagatcgtcaatacgaatctgaccagtgtgtttgcggcttcccaggcagccataaaacacatggaagcacaggggagaggcagtatcatcaatatttcttccgtaggcggattggtaccggatatctctcaggttgcctatggaaccagcaaagcggcgatcaattatctcaccaaattgattgcggtccaggaggcaaggcacaatattcgttgcaatgctgttctgcccggcatgacggcgactgatgcagtgcaggatcatctgagcgatgagttcagagaattcttcttaaaacacacgccgatccggagaatgggaaaaccggaggagatcgctgcggcagttgtgtattttgccggtgatgagtctgcctacactaccgggcagatcatggatatatccggcggattcggaaaagcgacacctatcttcggagacatggccgagatgaagcagaaacgctgaaaaagagcaggcaccaataaaggatgcctgctctttctgaatttatttagttttcttcgtcgtagtttgcgacctggcgttttcttgcagactcatcattttccagatattcatcataggttccgaggaagtcgatcatgccgctgtccgtgaactcaatgatacggttggccgtggtctgtacaaactgatgatcctgtgaactgaacaacagccctccggtaaacttgtggagcccttcattcagggcagtaatggattccatatccaggtggttggtcggctcatctaaaatgaggatgttggctccgctgatcatgagtttagacagcatacagcggaccttttctcctccggataaaacagaaactttctttaaggcttcttcacccgagaaaagcatacgcccgaggaaaccgcggacaaaggtgacatccttgtcctcagagtactggctgagccactctgcgatggacatatcttcactgaaatcctttgtgttgtccttaggaaaataggactgggaagtcgtgacaccccatttatatgtccccttatctggctccagttccccggcaataatacggaagaaggttgtggtagccagtgtattcgggcctacaaaagcgatcttatcctctggattcatagtgaaagagacattatcaaggactttcacaccatcgattgtcttggaaagtccttctacagagagggcatcgtttccgatatcgcggattggtttgaaattgatataagggtattttctgctggatggcttgatctcgtccagctggatcttatccagtgctttctttctggatgtggcctgcttggatttggaagcgttagcactgaatcttgcaatgaaatcctgcagttctttgatcttttcttcttttttcttgttggcatctttcatctgtttggagatcagctggctggactcataccaaaaatcatagtttccagtgtagagctggatctttgcatagtcgatatcagcgatatgggtacataccttatttaaaaagtagcggtcatgggatacaacgataacggtgttgtcaaagtcgatgaggaaatcttccagccagcggatggcttccagatccaaatggttggtgggctcatccagcagcaggatgtccggattgccgaacaaagcctgggccaagagtactttaaccttctgagaaccgtttaactcagacatctttgcatagtggagatcattgtcaataccgagtccgttcaggagcgttgcagcatcggattcggcttcccagccgttcatatcggcaaattcagcttccagttcgctggccttgatgccgtcttcctctgtaaaatcctctttggcatagatcgcatctttttctttcataatctcataaagccgggtattccccagcatcacagcatccagcaccgtgtattcatcatactggtagtgatcctgttttaatacggacagcctctggccgtctgtgatggctacttcaccctgagacggctccagttcaccggacaggatttttaaaaaagttgatttgcccgctccgttggctccgatcaggccataacagttgccctctgtaaatttaatgtttacatcttcaaataatgcgcgttttccaaggcgcagtgtcacattgattgcttgtatcatggaaataaacctttcttatttaaaattcgtttgggatcgtcttttttctattttacaggaaagtgaaactttttcaagtgatatttccacagaacagtaaaatgtgcaaggaaaaatacttgacaaacagaaagatatccgatacactatatctcggtaaaggaaaaacactttacaggagaggcagcatggaacggattgtagaacagacactcttatacgatttttatggagagcttctgacagaacatcaaaaggaaatatacgaagaccatgtactgaacgatttgtctcccagcgagattgcaggagaacacggaattacgagacaggctgcctatgatatgatcaggcgctgcaataagattctcgccggatatgagagaaagctgcaccttgtggaaaagtttttgaggacgaaagaaaaagtaagtgagattcatcttctggccaagagcattttagatgcagtggatcagcagcagatgaaaacagagatcagaaagatagagcaggtatccaacgggattctggaagatttgtaacagatcgccggtgtctgcggcggattcaggaggatgttatggcatttgaaagtttatctgagaaacttcaaaacgtatttaaaaatttgagaagcaagggacgactgacagagaacgatgtaaaggcagcgatgaaagaagtcaagcgggcgcttttagaggctgatgtcaactttaaagttgttaaaacatttattaaagctgttcaggaccgtgctgttgggcaggacgtactaaacggactgaatccgggacagatggtcattaagatagtaaaagaagagatggaggccctgatggggtccacgaccacagagattcagttgaaacccggcaatgaaatcacagttattctgatggcaggtctccagggtgcgggtaaaacgactaccacggctaagatcgccggaaagtataagcagaagggaaaacgtccgttactggtggcctgtgatgtctaccgtccggcagcgatcaaacagcttcaagtcaatggagaaaaacaaggtgtcccggtattttccatgggagataagatgaaccctgtggatatcgcaaaggcatccattgagcacgcggcgaagaatggcaacaacattgtcattctggatacagcgggccgcttacatatcgatgaggacatgatgacagaactgattgccatcaaacaggccgtcgatgtgcatcagaccattctcgtagtagatgccatgaccggacaggatgcggtcaatgtggcaaaagatttcaatgaaaaagtcggagtcgacggtgtcatccttacaaagatggacggcgataccagaggaggagcggcattatcgatccgttctgtcacagggaaaccgattttatatattggtatgggagagaagctggatgatcttcagcagttctatcccgaccgcatgacgagccggattcttggcatgggagatgtgctgactctgatcgagaaggctgaagctaccgtggatgaggaaaaggcgctggagatgcagcaaaagctcagaaaagcttcctttacctttgacgactttttagaacagatggagcaggtaaagaagatgggaggacttgccgacatgctgtccatgatcccgggacttgggaatcagttaaagggtgcagacctggatgacagtatgatggaccggaccgcatcgatcatttattcgatgacgaaggaagagcgggccacgccggagatcatcaatccttccagaaggaaaaggattgccgacggtgccggggtgccgatctcagaagtcaacaagctttgcaaacagttccagaaccagaagaagatgatgaagcagatgtctggtatgtttggtggcaagagcggaaaaaaaggcagatttaaatttcctttttaacgctttgttatagatatttttaacaattaaaatttatggaggtgaaacagatggcagtaaagatgagattaaaaagaatgggacagaaaaagtctcctttttatagagtggttgtagcagattccagatctccgagagacggaaaattcatcgaagaaatcggtacttacgatccgaatcaggatccaagtgtgatcaaattcgacgaagacgctgcaaagaaatggttatctcagggtgcacagccgacagatactgttgcaagattacttaaagttgctggaattgaaaaatagttaggaggcaaaacgcatgaaacatttgttagaagtgattgcaaaagccctcgtagatcaaccggacgaagtaacagtaatcgagcgtgagactgaagatgctttaatcttggaattacatgttgccccaggtgatatgggaaaagtcattggcaagcagggaaggattgcaaaggcgatccggactgtggtcaaggcttccgttgataaaggcgacaaaaagattgttgtagatatacaataaaggttaaaatcctgtaatcaaggtgttatactgaggttacaggattttttttgtgtcataaatcccagtatattgtaacagaaggagaaagactatgatccagttggtatcttggaatgtaaacgggctgagagcctgcgtgaagaaaggatttttagatgtaatggggcagttggatgcagatatcttctgcatccaggagacgaagctccaggagggccagatcgatctggaacttccggattattaccaatattggaattacgcagaaaaaaaaggatattcggggacggcagtatttacaaagatcaggcctttgtctgtaaaaaatggaatcggtgtcgacgggtttgaccacgaggggcgagtgatcactttggagttcgatgattatttcctggtgacctgctataccccgaattcccagagtgagcttgccagattatcataccggatggactgggaagaaaatttcagagagtatctgctcaaacttgaagaggacaagccggttatcctctgcggcgacctgaatgtggcgcacacggagatcgatctgaaaaatccaaagacaaacaggagaaatgcgggatttacagatgaagagagggaaaaattcaccaaactcttagaagccggatttattgatacattccgctatttttacccggatgtgaccgaggcatacagctggtggtcatatcggttcagagcaagggagaagaatgcgggatggcgcattgattacttctgtgtttccggggaccttgaagaacgcctggcagaggcagtcattcatacagatatttatggttctgaccactgcccggttggactgtacctggaataatagaaaggactgaggcttatgaagatgctgaaaaaagcagctaaaatcatggcagtggtgatcactgcagtcgtttttgtgtttacaggattgctgatctttgtcacggtcatggaataccggccccaaaagacagaaagtataaagaaatcagagggaaccagagagatttccagagaagatccatttaccgtggtcagcctgaataccggatacgccggcctcggaaaggacgaagacttctttatggacggaggtacaaaagtgagaccggacagcaagattcaggtggaggaaaatcttgcagggatcgtgggcatgctgaaggaacacaaagcggacgcttattttctgcaggaagtggatctggattccaaacgctcttattccactgaccagaaaaagtattatgaggctatgctgggactgggcggaatgtttgcctataactttaaagtggcttacgctccgtatccatggccaaccatcggacatgtggagagtggccttctgacgctgacggacaccagggtcagcaaagccgaaaggattgctttgccggaatctttttcatggcctcttaaaacatgcaatctgaaacggtgccttttaaaaaccaggctgccggtcaaaggatcaggggcggagcttgtgctgatcaatctgcatctggaagcctatgattccggagaaggaaaagaagcccagagcaaaatgcttctgaacgtattggaagaagaatataagaaagggaactatgtgatcgcaggaggagattttaaccagacttttgaggggatcaccaagtatccgatccgcaataaagaagactggtctcccggagctatcggaaatgagattcttccggagggctttaaatttgcagtagatgattcataccctacatgccgtctcctgaacaaagcctatgagaaagattcacaggtctatgtgattgatggctttatcgtctcgccgaatgtgcaggtggagcaggtgaaagtcttggatcatgattttcattatacggaccatcagccggtcaggctgaaagtaagactcaaataaaaaagaaggggctctcctgtatcttaacaatacagggagcctcctttttaatcgtcttctttcaggtcgatttttttcgaagcctgatacaggttaataatatctgtcaaagactcttccattttttcctgtattccctcaagtttatcggggtctacattgtaatttaaaaacagtttttctatgttttctgtgacatgatgtcccaaatgcgaaatgatcaggaaggtatcaaagttcttgctgttctttgcgttcacaaaacgctttaagtcactctggataaattcgaggatctcacgatcgctggcaaattttccgtggatcatcgcatagggctgaacacgctgcagaaagtatttgttgtggcgggtgatattaaagacataggacacgatcagaccgtctcccaagtcaaattctgctatgtgcattatgctgttatattctttgattgacgtggcgcccagctgacgcagattaatgttaataaaatcgctggttactgtgttttcattcataaaaaatcctccttaaaaagtacatactgtgaagcgcatttcttagcgcggcggaattaatttaaaaaaatatgtgaatttgatcagtaaaaagacggaacaaactgcaatggagatcagcataattggaaatcccactataaaatatttcccgaaggagatgggatagcctgcatttttgctaatgcctgccagcaccacatttgctgaggcaccgatcagagtgctgtttcctccgagacaggcgcccatccaccagagaggttctgcatggaccccactggcctgcatggtaaagatcatatttccgccgtttaaattcttcaggcgtttatctttgatggatttgtgttcatccggctgcatcactttctgtacattcttttcatccacagtgaggctttttttataaataaaccggtaacagataattgaaacgatcatgctaagaacaaccgctgccccggtattccggataaaatccataaagcttagatttgtggccgtaccgatcataatattgggcgggtaaccgatcaaagtagctgtacctccggcattggatgccatgatttgtgtgagcatgtaaggcaccggatcaacttacaatatatttgtaatagccagagtcataggtcctacaaggagaattgtagtgacattgtcaagcaggccggacagtactgctgtgatgatgataaaaacaaccatgatgggccacggactttggcgagcttgtcagatttgatcgctatgtattcaataataccggacgtcttgatgacagataccataagcatcatccctaccaagattccgatcgtctctgcgtcaataaatccgacacagtcttcaatagaaagaatatgggtcagtacaagaagcagaatagctccggaaacagcggccagcgtattgtttaccctgttcgtgataatggcagccattgtaacaacaaaaataatgattgcagctatttgatctgcagatataaaaccccttctataaaaacagtagttaaataattatgaaaaccggatcagcagaaaaacagagcatataaatactgacagtatcatcataggaaaaccaattttaaagtattttccgaaagtaatcggatatcctgcatttttactgatgcctgaaagaactacattggctgaggctccgaccagtgtaccgttgccgccaaggcaggctcccagggaaagtgcccaccacagaggagtcacatttacaccgtgagactggattgtcatgatcatcggaatcagagttgccacaaatgggatattatccaggaaagatgaaacgatcgcggaaatccaaaggatcagaagcatagtcattgttatatttcccccggtaactgagagcagcccattggcaagaactgtgatgactccgaccttctccagaccgcctacaacaatgaataatccaacaaagaaaaggatggtcggccattcgacgctcagaataatatcctcagggtcctgtccgccgatgatcagcatcagacaggcagcggccagagcgatggttgcagactgcatttgaagctggtcatggaaaataaaacataatgcaacaatcaacagaatgatcacgctctggatcagcagttttttacttttaattgcttttgattcatccagcttcatgacttcctttatatttttatcttcgacggtcagactgtttccgtagataaaacggaaacagatcagggcggcaatcattacaaaaacgatggcaaaaccagtatttaatatgaaatctacaaaactgagctttgccgcactgccgatcatgatattgggcgggtccccgatcagtgttgcggtacctccgatattggaagccatgatctgtgtgatgatgtagggaaccggattgacacctaaaatattggtaatagccagagtcatcggcccgaccagcagcacggtggtaacattgtctaaaagtccggataaaacggctgtgatgatgataaacgtgaccatgattggccaggggcgtccttttgcaagctttgcggctttaattgcaatatattcaaaaataccggaatttttgactatggccaccaaaagcatcatacctacgagaataccgatggtctctatgtctacggcctcaacgcactcgtcaatggtaagaatatgggttaaaattaaaaggatcgcacctgaaattgcggcaacggtgttgtgaagtttgtctgaaatgattgcggccatggtgattaaaaaaatggcaattgcaataatctgttgtagtgacatgatatttccccctaatcattaaagtttattcctattgtatcaccaacagacagaattttcacaatttatatagatgttttttattcagaacaaggaagtctgctaaaattatataatctctcggaatcctgagtgattattatcggcaacagccgagaaacgtactttgaaaagtaaatattatttaaaacagaaaaaagaacatagaaaatagacataactgtcgctatgcctgaaaaatggtgtataatagtaaaggattatgccacatctaaaatcaactttctcagggtggattcatagggcaaatcccaagcatccaagtgctgcagcataaggatgtgatataggcggcagtaccacatcttagttgagcggtgcctgccgctttctaattgaaagtctattttctcacgtttattcgaacgttcagctgaagttctggcattgtattccagtttccattctttactgtcacgaggcgggaaattgatgaatcttggattatctttcattgcaagatggacggttctcccatatttggagtctgagcagggggtactgcaggagcatccgtatttacggctggcaagtggacagcgaaattttaaccttgctttcgatggctcagaaccatcatggttcatttttcgcccagctttgcaaataggaattccatcttttgcaatggtaaaatcatccttatatttcatgctaattccgcgtttttcatttaagtcgataaaaggctgtatgccgttttcacggcaatactgataatacggcatggcatcatgagcagaatccaaaagccatttgctgatatgaaaatcaggaagaaaggctctgaaacgaaagtaagtttccaaaaaaccatgagaatcatgttttgaggcaggattgagtaaagggaataaaggcagatcactttccgagttggatgcaaccagcatatataaatcgtagccatgataaaaacagtctcgagaagaatcatatccgacatcacaatcgggctgggaaaagtagcggtcgcaatcacaggaagtgataccattttcggaacacttacagatacggtgtttccgttcacgtgcagatgtaacaacaggcataccgtcaccggcaatggaaagattggaggtatcaatcaatcctttggagatggaaacggttaaaaattcatggttgtaaatcttgaaaagagaagcatatggttggtcatcaatagaaaaagaagaagattccatggatttaaaaagttgttccactgtgattttttcaatagattctgctttttctcccttctgttttggcttttgcacttttttcttttttaaaggatgtatatggggagaaagattatcagaatcggaatcccaaagcctgttaagaaagtcatagaaagtgccgactccaggagtgtcaccaaagcgaaacccactgaggattgcatagagtggattgattttcaattgagcagcccagtcggtaagtgaatgaactttaaaatcaatggagagaagataagaacgctgcatacaggaaggagtccttggttttggaccaaagacagaatatttgctgcggagcagttcgtcggtataagaaagatcaagattccagaaacgttcgatgatatcccacgttgatttagaaaaaacagtgggatcaggataatatttacgaaggttttcaagtaaaaaagtctgataggcggtatgaccgccggaataaacaggtaacataaaaatcgccctccagtcgataaaaataaaatatatttaatcggcttcgccgcaaattttgagcgatttgtcaagtcttttttgacaaaaaagtgggggattttaataaaatggaatctacaagccttgattttactgggctgaagattccgagagattatttataggaaagggcggaagaacaatttcaatattcaaaaaagaagatgaaggctgcctctcatagaggcagtacactgacagcaaaacagctgccccgataagacagctgctttagtcattgattacattttgtctacaattttgtcgtacaagtccagacagcaatgacattcttcttccgagaaatgagaacagttcagacagctctcacattttacatcgtctccgttactgacatttttgacagagtggtcacggccgcaagggcagtactgactgcagttgatcgctacttcttcatatattttattctgctctgacatctgataaagcctcctttttatatttgaagttactttatcagtattgacggatctattccggataattcagatttttctcatttgcagtatataaggaaaaagtcaaatatttgtaagcaaggagttttgccataggaaggttcatatcgagataatttccacagtctctggcagatgccccgggaacttctccttcgaagtctcgtatatactcaaacgtttcttttaccagctcaagtatctcgctggaagtctgatctccggctaggatcaaatagaaaccggtgcggcagcccatgggtccaaagtagatgacctggtctttatattcagcatggtttcttaaaaaggttgcgcccagatgctcgatggtgtgaatctcagcggtgttcataactggctctttattcggtgcggtcatcctcaggtcataggttgtcaatgtctctgtcccgagtgaatccctgcgagatacatatactccgggcagaaggtctaaatggttgaccgtaaaacttgcaattttctgcattgaaaaaaacctccatatataatgtttgtctgaatattagtgtaaacagcatatcaatattataacagagataaaagaaaaagcacgaaaattacatataaacagaagacctcaggcaatttaagaaaataaaatttctgaaaaagctcttgacaaaacataaaacggaccctataatataatccatagtaaacctagtgattaagtaggaaaataaagagaggaaatagtgatatgagtaagataaaagaaagtgcatcagaattaattggaagaacaccattattaaaattgaatcgttatacaaaaaatgcaggagttgaggaagctgtgattcttggcaagctggagtatttaaatccggcaggttctgtaaaagatcgtattgctttagcaatgattgaagatgcagaagaaaagggaatcttaaagccgggggctacaattatcgagccaacatctggaaatacagggattggtcttgcagcagttgcagcagcgaaaggatataaggcaatcttaactcttccagatacaatgagtgtagaaagaagaaaccttttaaaggcttatggtgcagagcttgtattaacagagggtgcaaaaggaatgaagggagccattgaaaaggcggatgagttgaacaaatcgattgaaggttctgtgattcttggacagtttgtgaatcctgcaaatccaaaagttcataaagaaacgacgggtccggaaatttgggatcagacagatggaaaagttgatatttttgtcgccggtgtaggaacaggaggaacagtgactggtgttggagagtatttaaaatcacagaatccagatgtgaaaattgtagcagttgagcctgaaagcagtccggtattatccaaaggtactccgggacctcataaaattcagggaattggtgctggatttgtgccagatatattaaatacaaaagtatatgacgaaattattactgtggaaaatgaagatgcatttacagaagggaaagcatttgcagtcactgaaggtattttagttggaatttcttccggggcagcattaaaagctgcaaaagaactggcagccagaccggaaaataaagggaagacaattgtagttttgcttcctgattctggtgaccgttatttatccacgccgttatttggcggaaactaaaaaatggctgaaattatatacccgcagggcacaccgtattttatacccttcgggtggacgcgctccgcgcgataaggtataagtttcgagccccattcatatagtatagtgctgactggacaaccagaggtttgtattgggatattcggaatctgataaggaatatgcagatgcagtggtaaaatggtatcaggaacattttcaatggaagattgaaaggaattggattgtaaaaacaccaggtgttgtttttgctttggctgctgcagttagagcttttacaaacgaaggagatcattatgagattgattttgaggattttgaaagaaagattgtgtcaaatcgagtaaaattttttctattctgtagtccacagaatccaacgggacgtgtttggagagaatgggaattagatgaaattcacagtgattttataaattttggatatatgcatcttatatccaatcagaaactccgcagaaaattccgaaacgaaagaaatatttttaaaagattatgtagaagtaaattttcctaatatccgagtgatcgaacctgaagggacctatttagtctggttggattttcgagaattaggacttcataaaaaagaaagagaagatttgatcgtaaatcaagctggattatggctggatcaagcttcaatgcttggcccggaaggagaaggatttaagcgtattaatattgcgtgcccgaggaaagtcctttggcaggcattgaaacagcttaaaaatgcaatatcataatatattatatagagaaaaaactgactggaaaaccagaggttgcaagaatcaagcaaaattgcttgattcttgcaacctctggttttatattttgtaattttaggaggaaagacaatgaaaaaagtagtatcaccgcaggaacagcggattcaatatgaaatcgaggaaaaaaaaccagcattcatccatgaaaatcgtgcgacaaaaattttgagtcgtattcgaggagaaaaaccacaaattgatattgaaagaggtttgtattttacacaatcttttcaggaaacagaaggagaacctttaatcttaagatgggcaaaagcattgatgcattatgtcaaacatgcaacggtctatattgacgatgatcaactgctcgttggaaggagtggaaaacagggacgctacggaatcctttatccggaattagatggaaacacattaggggaagcaattgagacattgccgacgcggacaatttctccattcagcatttcagaagaagacgccaaaatcgtgtctgaagaaattgccccatactgggtaggaaaaacattccatgaggatcttgccaagtcatttacaaaggaaacaacaaaattaacatataatcaggataaagaacttacatcaagatatattgtgaatgaaacagcatcttttcgatcttctcttcagtgggtacatgattacgaggttgtgttagaaaaaggatttttaggactgaaaaaagaagcggaggagagactctcagagttagacgaatatagtccggtggactatacagaaaaacttccatttttacagtctgtgataattacctgtgatgccataattttatgggcagaccgccatggtgatcttgcagaaaaattagcccaagaagaaaaagatccaaaaagaaaggtggaattattaaaaattgcagagacctgccactatgttcccaaaaatccgccaagaactttttatgaagcaatgcaggcgcagtggtttacacagatgttctcaagagtggagcaaaaaactggaacgattatctcgaatggaagaatggctcaatatttatatccattttatttgaaagataaaaaggccggcattattactgacgatgaagtgcaggagttatttgaatgtatgtgggtttctatggctcagtttgttgatttatatctttctgaagctggaggatccttcaatgaaggatatgcccattgggggagttacaaaacaggggtatgatgcagtcaatgaattgacatatattttattgaaatcgaaacgagaatttccattaaattatccagatttggcagcaagaattcatacaggaagcccaaaacggtatctgtatgaagtagccaaaaccattaaagacggggctggattcccgaaattaatcaatgacgaagaagtagtgccaatcctgctttcgaaaggtgctgcttttgaggaagcatacgattacagcgtgtctggctgcgcagaatgccgtatgccgaaccgggatacttataccagtccaaatgcttatattaactttgcagaagcgctggaaattggtaggaagttttacaaagttttcaccgaacccggatgtcgaggaggtagatcagcttgcacaacttctgccaaaggaagggaaaaaagcccccattgcttcggatagtttttatccgcaatatgctgtgattgatccggagctgaccgtgtcaatatctcaatatcaattccccctggagaagcctgcggatggacttaaaagataagaaactgacacagaaagaaaaagagcagttaattttattaagtcatcatccaaatcttgaatataatctagtggaaattacagatgaaattttaaaattcttttgatttttcgttccttgtaggaggattgcaaaattacatggaatgggctgttcagcatatgcaatagggaaaaaacttggaagggcaagcaatacaataagaattgaactaaggagaggaacggtgtcgcagatgaaaggcggcacaaatgagatatccgccgaaaagtaagcagtaagctgaaaaaggagaagggaagaacagcgcagtttgtaaaagaagtggaagatattcttgaggaaatgcccagaggagtattccggactattacaagtgataacggattagggttttcaagattatatgaatttgaagagaatgataaatttttggtgtattatgctcatccatatgcttcatatgaaagagggagcaacgagattaataacaggcttatacgcaggcattataaaaaaggaaagtatataaagaatcagccggaagagaaagtcaagtatgtggaagactggatgaataatatgccaaggcggctttttggataccggacggcaaatgaattatataaggaagaataatagagagttaaaagaagttgacaaaaggagaggattggattgtattaaaatagatacaaaaaaatggttcaaaaaagggttgcaatttaagtttaaaaaaaagtaaaaaaacctgttgacatttgtctggagcgatgataagattatcaacgttgctgacaaaacagcagctcttcaaaactttatctgacttcttggctcttcaaattttttgaaaaaagtccttgacttggaaagcatgccatgatatgatataaaagttgctgacggtgatcggacagcacaagaaatgtcagtcattcatgaaacttcaaaaaaatgaaaaaagtgcttgacagacagaatgaagaatgataatataataaagctgtcgctcgtaagagtaagacaaaaaacgacagcagatctttgataattgaacaataagacaaccttgaaaattctaagagattttcagtatcttttgaaaaagatacacgaacgttctttataaaaggacacagtaaaacaaggataaaaaagccagcgctttttagatccaagattgaacatgagagtttgatcctggctcaggatgaacgctggcggcgtgcttaacacatgcaagtcgaacgaagcattttggaaggaagttttcggatggaattccttaatgactgagtggcggacgggtgagtaacgcgtggggaacctgccctatacagggggataacagctggaaacggctgctaataccgcataagcgcacagaatcgcatgattcggtgtgaaaagctccggcagtataggatggtcccgcgtctgattagctggttggcggggtaacggcccaccaaggcgacgatcagtagccggcttgagagagtggacggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagaaaaaagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatctaactgaccggttcgtaatgggacctttccttcgggacagttaagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccttataggagggagctgccgaaggtgggaccgataactggggtgaagtcgtaacaaggtagccgtatcggaaggtgcggctggatcacctcctttctaaggaagaagaagtaggggttgtcttattgtttagttatcaatgataacaaaaagtatcaagcaaggaagttctattgcactaaattcgctgcgccataactggctggctcattaagttgcaaagaacaactttcgtactaagctcgaaagtacctcgctaagtactcaatgcttccggtggcgatgcgttttggggacacacccgtacccatcccgaacacgatggttaagaccaaaacggccgatgatacttggttggagacgacctgggaaagcaggtggctgccggatcttatttaaacattctttggtgattcgatataagaacaaagttcttgtatggaatggctgaagaagccaaaatagaaagtgtaacagagattgttggtggtgaaagcatctcagagacttcgtctcttcgatcgcggcagagccgctaatacaagcaaaaagtaattctgcttaggaatgtaaacattccacacagaattccgttttccttgtgctttcaatcctgcatacgcggatgtaccttgaaaacttcatacagaacacaaaaagttattttttataagaaatgacaagacatcaaacaaaacgaattacccgttgtcatcacgctagatgacaatgaggatgatagaacaactatcgtccgttctatggttaaagtagaaagagcgtagggtggatgccttggcactaagagccgatgaaagacgtgataagctgcgataagctgcggggaggagcaaatatcctttgatccgcagatctctgaatggggaaacccggcggagtatccctccgtcagcgtatggtgaatccatagccatacgtggggaacccggggaactgaaacatctaagtacccggaggaagagaaagaaacctcgatttccaaagtagcggcgagcgaaatggaaagagcccaaaccagaatgcgtgcattctggggttcggactgcgacatgggattatgtatgacaggagaacggcctgggaaggccggccagagagggtgaaagccccgtatccgaagtcagaagtaccctagcaggatccagagtaccacgagacacgagaaaccttgtgggaatgagcggggaccaccccgtaaggctaaatactccttagtgaccgatagcgcatagtactgtgaaggaaaggtgaaaaggaccccgggaggggagtgaaagagaacctgaaaccctatgtttacaagctgtggaacccctttagatggggaactgcgtactttttgtagaacggtccggcgagttgcccgtactggcaaggttaaggacttaaggtctggagccgaagtgaaagcaagcgttaagagcgcggtagatgatcacactttgtgtggtcataacagtcagtgagggcagacccgaaaccgggtgacctatccatgtccaggttgaagcttccgtaagaggaagtggaggaccgaacccacatccgttgaaaagggtggggatgaggtgtggatagcggagaaattccaatcgaacccggagatagctggttctcctcgaaatagctttagggctagcctcatcaaagtctgctggaggtagagcactgaattgtctagggggcgtcaaagcttaccaaaacatatcaaactccgaatgccagtcagatgattgatgggagtcagactgtacgagataagttggacagtcgaaagggaaagagcccagaccaccagctaaggtcccaaagtacgtgttaagtggaaaaggatgtgggatttcaaagacaactaggacgttggcttagaagcagccatacattgaaagagtgcgtaatagctcactagtcgagagatcctgcgccgaaaatgtccggggctaaaacacgacaccgaagctgtggaatgtagaaatacattggtagaggagcattgtaagcgggatgaagccataccgaaaggagtggtggactgcttagaagagagaatgccggaatgagtagcgagaggaaggtgagaatccttccggccgaatatctaaggtttccagagtaaagctgatctgctctgggtaagtcgggacctaaggcgagggcgagagccgtagtcgatggataactggttgagattccagtaccacataaaaacagaactgtggggacacagaagggaaatgggagccaggaatggaaagactggtgcaagcgaagtagccgtatgggaggcaaatcccccatgcaaggcaaaggcgttacgcggaccgaacaaaagtagggaagcccaggcccccagctgtcaagaaaagccgctattgttttttatgtgcccgtaccgtaaaccgacacaggtggatgaggagagaatcctaaggccgacgggagaagtgttgttaaggaactcggcaaaatgactccgtaacttcgggagaaggagtgccaggtaagactggccgcagagaattggcccaagcaactgtttagcaaaaacacaggtctatgcaaaaccgcaaggtgaagtatatgggctgacgcctgcccggtgctggaaggttaaggggagggcttagcgagtgatcgcgaaggtctgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacctgcgccaggacggaaagaccccatggagctttactccagcttgatactgggattcggtactgcatgtacaggataggtgggagactgagaaagaaggacgccagtccttttggagtcactgttgggataccacccttgcagtattggatttctaaccaacagccatgatctggttgggggacaatgtcaggtggggagtttgactggggcggtcgcctccgaaagggtatcggaggcgctcaaaggtcttctcagaatggacggaaaccattcgcagagtgcaaaggcagaagaaggcttgactgtgacaccgacgggtggagcaggtacgaaagtaggacttagtgatccggtggtataacgtgggattgccatcgctcaacggataaaagctaccctggggataacaggcttatcactcccaagagttcacatcgacggagtggtttggcacctcgatgtcggctcatcgcatcctggagctgtagcaggttccaagggttgggctgttcgcccattaaagcggtacgcgagctgggttcagaacgtcgtgagacagttcggtccctatccggcgcaggcggaggaaatttgataggagctgtccttagtacgagaggaccgggatggacggaccactggtggatctgttgtattaccaaatgcatagcagagtagccaagtctggaagggataaacgctgaaggcatctaagcgtgaagcccccctaaagataagatttcccatagagtaatctagtaagaccccttgaagacgacgaggtagatagggcagaggtggaagtgcggcaacgtatggagctgactgttactaatcggtcgaggctttaaccaaagaaggtaaggaagatgtttgatgaaaggttctgtatgtagttttgaaggtacataaaatgaaaaagagggataaaaaataaaagtattttttatctttttgctgtataggggcatagttcagttggtagaataacggtctccaaaaccgcaggtcgagggttcaagtccttctgcccctgttaaaaagtctaggaaaagttaatttcctagactttttcttttacttattatcacaggcagtttttttatctgtaggatatccatttccctgtgcatctgttccgggatcacctgatgcaatatcgttgctttttttaagtgcatgattggtgatcccagcctcataggacccttttggaattgtattgatttcttcgtcgcctcttgcttttttcatgtcgtcctcctttttctgcatttatattatccccaaaatagaataaaagattaaagatttttaaattaacagcaagcctccaaagaggtaaaaaattcgtgctattgacaaaaggacaaaaaaggctgaatataagatttaaagatgaaagagtgtgcagtaaatagaaaattggaaaggaaataaaatatgagaagaaaagatagacaaattacagaatttaacgaaatcattgagatcattaaaaagtgtgatgtttgcagaattgcattgaatgataaagattttccctatattgttcccttgaattttggattagatatacaaggagatcaagttttcctgtattttcatgctgctatgaaaggaaaaaaattagatttaatagcaaaagataatcgtgcagcttttgaaatggactgtgaccacaattttattctttatgaagagagaatgagctgcaccatggggtatgcaagtgttactggacatgggaatatagaatttgtaccggatgaaaataaatatgaggcactgaaaatcttgatgagacattatcatgcggaagattttaaatttaatatggatatgatgaaagtgacaactgttttaaaaatgacagttacagatatgatagggaagcgaaggaataatatacattaaatattttgtatatgattttcgttgcagagccggggattagccctcggactctgcaacgatttcctccagaacacggatgaggtcgtggatcgtatttaactccacgttgcgttccaggatcatatcctttaattcgatactgagcgtttcaaattttggacgaagctcaggagaaacataagacatctttatcacctcatagaatagtatgggcaaacttctggattctcattaaataaataactcataaatacctaaaattaagattaaaagtccggaaattaataccgcatagtttccgaagatatcagacagaaatttttttcctgcagccatgcctgttgtgagaaagaataaactaaagaaaaacgtaaaagcagaggtaagatatggatttaatccggtgattcctgcaccaaaaccgagccccagattatttaaagtcagcgccagggaaagagcaaccaaagatgctatgggcatagaatgccgtttggtactggtacaagacaatgttttttcttctttctgtgtcagttcgtccggtacatttttcttaaaaaagtaatccatcatcatccagatgccaagaaagatgatgataaggcatccgaaggtatttgctgtggagatcggaagaatactcacaagccattcaccgagaaacatggataagtaggtgcctatggaagtaagaaaagaaattgtaatattatctacaatatgatatcggtatcctttggtgccgtaagcagcgccaagaaaaaaagcatcgatattcgctgagatcgaaaataaaatgacagatattagatgcatatgaaatccttttattttgttgttttatatatactatggcaaaagcaaaaatcagttctaaataaaaatattattacaactggtaatatattaatattaccagttgtaatatacaaaggagtatagtataatagtagtatcaaaaaagtaaaatcaaggaggataaaaatggtcggtattttaattgctactcatggaggttttgctgagggtctgttaagcgcagttgagctgattgccggaaagcaggaaaaagttgagactgtcggcttgtatcacggagacggagtcgatgaatttgaaggtaagatcacagctgcaatggacaagctggatgacggagacggtgtgctggtgttcgtagacattctggggggaacaccttcaaacaccgttatgcgctgcttttcaaaaaaagaccatatcaaagcgattgcaggaatgaatatggcaatggttgtgcaggcagtcatgatgagagacggaacagatttggattcactatgtgcagaatgtgttgaagttggaaaccagccgccgattctactgcatgacatgtatgcagatatggtaaaacagcagagtgaagatatagaagaagacgaaatttaaaaatatgtttgaggatgcagccgggtttcccggctgtttttcatttcataggaaagttctacgaccttccctatgaaataaaaacgctccgcgggttgtgcacagatgcgtaaggaaattatttgcctgcggcaaattgcatctggcacgcaaagttgtcaagcccctcaaagagtgaggggttggggcgttgaagtgggcttgcccactttgttcccaaattttgattatataaaaaggacacccgctaaaaagcggatgcccaaccaacaaaaatgagttagagttaccaaatttaatctaagatactgcttgcaaaaactttcatagcagcttttacgttttctttcatggcagctttgccggcagcaatgatatcatggaaaaatactttttcacctccggcatcattaatgaattcacggactttgtttcctccggccatagcactgtatgtatagtagttgatcttagtgattccattttgaattgatgtcttgaagtcttcatcagaaacaccggaaccgccgtgcattacaaatggaatatcaatcttatttttaatttctgtgatacggttcaagtcaagctttggttcggttaagtaaacaccgtgagtggtaccgaaagaaatagcaagtgcgtcaacaccggttccttctacgaatgctttagctgtatccggatctgtatagcagtcttccaaagattcaaagtcttcggctcctacagctccgcgtccttctccgccgcctacagcagaagtgaagatgtggcctaattcagcctcgacagaaacacctgcagcatgtgcgatttttaccatttcttttgtttcttcaaagttttcttcataacttttggcagaagcatcatacatgacagaagtgaatcctaaacggatcgcctgtacacataagtcaaaagatgcgccgtggtctaagtgaacacaaacaggaacagaagcacgttttgcgtagtccagcatgatcggcccgatctcctgcatagtgattaagttctcatgtacctctgcatgctggatgatgacaggaacattgagttcttcagcggcagagatcactgcctgtatagattccaggttaggaacattgaatgcgccgacagcatactttttctcttttgcatcttctaaaatttttttcattgttactagcatatcttatacctccgtgaatcattaattacttggctataaaaaattataaccgatggtaataataaagtcaaatataaaattaccaatggtaataaaatgaaataataaaaatgtaaaattattgtatagaaaaattaatgtaattgtaattgtaatatatttctatgtaagttataataaaaaaagtataagttaaacgattagcaatataaggaggtataggttatgaagaaaaaaattgtagtagctttatgtgttttaacattagtattaggttgtaatatttcaactagagcggccgattatattgatggcgttaatggattcggagggatgctaaaagcgaatggaaaaacaaattatgttccatgttatcctcaaaagttagggaataaaaatggaaaatggagtttgaaagtagaaaaagttccagggtggggattacaatatgaaacaaaattttgggtttctacagttaaagtatcaagtaaaggaaatgtaactgaagtgaaaagaatttcaaaaatccatactatatcaccaaagaacgcaggaaaaacatataactatagcgatggtagtgctatgtataacaatggaaaaggaaaaaaggttgcattgtttgcaaaaacaactaaaagtcatggaagtaataagtacttggtttctggatattggacaagataaaaatatttgagattttaaaatagtggttgtagcatattagctcaaccactattttttttgagaataataaaattttgtgtatagattttaaaggcattgaggttgattttgatgaagtattttagattatagaatctagaagtaagtctctattttgtttaatggaattattggaattaaatagaccagaagttccaccagtaaaaatatcagcaccagattgagaaagaagttttattgttaatatatttacatttccatcagcttgaatatgagtaggtaatccggcagtttgaagtctatttcgtatttcttgtatatgtagcaaactctccttcttaagtgtttgacctgaaaaacccggattaacagtgagttttaaaatccaggggacttcttttgctagtgagagtaaatcgtctggtggagcagtgccacacttaaatgccaatacaggttccgctccaaactttcttattaaatcaaaggttttcagtggatgtttcatggcttcgtagtgcaccgcaatataatctgccccaagttttgcataacgttcaatataagagtctggatcatatgttgccaggtggacttctataggtaaggttacttcagagcgcatcatttctaatagtgtatctcccagaatgaagcaatgattaaatttaccgtctaccatatcataatgaaaaaaagagataccggactgttctgtttccagtatttgttcttttagatgaagcaaatccatacaggatacagaggcagaaacacatggggggtcgaatataagttttttcataggcggagccttcctttcctctaaatgaacgaaactaagttgtatcttttcgttcagtataagaaaaaaaatacaaaaatgcaacaaatataaccgatggtcataaaatttgtataatgtttataatttttttataaatttaagtcacttttcacaaaaagaatgaaatattataaaaaaagttgacattttagtgagtggtggtaatatagaacataaccagtggctatattggagggtagccagaaaatgagtaagagttcatatttttttctaacgaagggagcaggcattatgaaaatcgaaggtatcgtattagtgaggattgatgacagactgattcatggtcaggttatgacttcctggttaaattacaccggagcaaacaaaattatgattattgatgatgaagttgcaaatgatccatttatgaagagtgtattaaaaacatgcgtaccggcaaacgtgaaactggcgacatttacagtggaaaaggcagcggtaagattgaaaaaaggttttgcaggagacaaatgtattattctcgtcaaatatccaaaaactttatatcgcctgaagagtgaaggagtcgtttttgatcatgtcaacatcggaggaatgggagttagtggagatcgcaagaaatttttccgcaatatttctgcatctgatgaggaaaagcagatgttaaaagaactagtagatgcaggatctaaaattggagtcaggatcattgcagaagacagcgagaccgacatttcaaagatgctttgataatggctaataagggactgataatatgaacataaaatatgagaaactattaacagaaagcggagaataaaggaggtaaagtatgaaaattacactgattcaagcgcttttgattggtatcgtttattatttgggtaatatcggtacaccatggttgtcactgctgggaagtatttctgtcgtttacaaaccattggtagcaggaactatagtaggttttattttaggggatccggtacagggctgtatgattggtgcagcgattaacttaccgtatgtagcttttatttcagcaggaggaactgcgccggctgacccgggacttgcaggaacagtcggaacagcctgggcaatggcagcaggggtaagtcctgcggtagcagtgactttggcagtgcccttggggctgctcggaactatgatttgggtcgcacatatgactttggatgttacttttgtacatatggctgataaagcagcagaggaagggaatatcgaaaagatttgtttctatcatgttgttccaccccagatcttgatgttttgtttatgtgtaattccggcaacggctgccacatatctgggatcatcagcagttaaagggttaattgcacaattgacaggtaaaccattggatgtattagctgtaattggggcattgcttccggcacttggaattgcgatgaatcttagagcaattagtaggccaggtactttattattctatattgtaggatttattcttgttgtatatcttggacttccggttattgctgtagctgttttagctggtgttataggatatttctatacaatgttgagtaaccaaacaccccaggtagcagcagctgattcaggggcagcagcttcaatagatgatgacgatgaggaggatttttaatatggcagaagaaaaaaagaaacaactaagtaaaaaagatgtcgtaaaagccttctggagatggacctttttctctcatgcaaactataattatgaacggttagaagctacaggtcttgtattttcttttaaacacgtaattaaaaagctgtatggagatgatccggaagcctacaaagcatgtattcaaagacatatgcagttttttaatacagaaccgcatataggcggtgttattccgggtattgttttggctatggaagaagaacgcgctaatggagcaccgattactgatgaggcaattaatggtgtgaaaacaggtttaatgggtccatttgcgggtattggtgataccctctggcaggggacattaacaccgatattactggcatttggtgtcagcattggttctaaaggaaatttaatggggccattagtttatacattattaatgtttggaattatgtttccagtagcatatatttgttggatgaaagggtatagtttaggtaaagaaggtattgaaaaaatccttggtggaaaccagttacaaatgttaattacaggtgcttctgcaatgggagcaattgttttaggagctttgtcggctcagtttgtaacggtgcaatgttcagcaattataaaacttggtgctttaaagatgaatgtccaggaaacagtttttgatgcgttgttcaaaggaattttgcctttgggatttacgttacttactttatacttattaaagaacaaaaagatgaaagcgacaacagttatggcaattctcattgtcattggactagttggaggagctataggattccttggtgcaaaatagaatagcgtggagggaagaacaatgggagaaatggcaagaacccttgtgtttacaggggaaaagcaaattgagatacaggaatatccgattcctgaagtcagtgatgatatggttctggtaaaaacagatgcgtgtgcgatctgcacatgggagcagagggtttataccggagtaaaaaaagtagattttccgtttattggcggacatgaaatggtcggaaaaattgtcaagatgggtaaaaatgtggaccagagacagtggagtgtcggtgattttgtggcagtcggggtaacgctgccatgcaaaaactgctatcagtgtaagagcggaaatgagcagaactgtgaacattttgatcacagcaaacaattagagggacttccggagaaaggtatgggcggattgagttcccatctcttagtacatccgtcaaacctgtttcacctacatgatataacaccggaagaagcaacgatcacagaaccattatcctgtgtgctgcacagtgtagaaactgctgatattgaatttggtgataccgttgttgtgatcggatgtggaatcatgggactgctgcacacgatcctcgcaacaaaacggggagcctctgtcattgtctccgacacgaatgaagaaagaacaaagctgggcttagagctgggcgcaaattatgcggtaaatccggcgaaggaaaacctggaagaattcgtgaaggaaatcacaggcggaaacatggcacaggttgtctttgatacgacaccgatctccaaagttgccgaggacgcagtgaaggctgtcgctaacaacggacgtctggtactttacagttcattctatccggatactccgatctctatcagtccggattggcttcataagagcggtgcaaagctgatgggtacagcaaactccaacaccgtagattttacaaaagcgacgagactgctctcagagggagttgtggatgtaaaaccatttgtcagtgaagtctatgatttgagtgattatcagaaagcatttgaatctgccattaagggcgataaattcagagtagtattaaaattctaaagacgggtgaccttgttggttgccgctgtcaggatgcggataaagcagagagggagccggttaaataatggcttgctctctgtttttctgaacaaatgtatatttaaaaaaccacttttatccaacaggatttatggtgtatactataggtatctggggtaatattcgtcaagaactgaggtctcttatacatacaaaggagggcgtatgagtgaagtgaaaaaaaagcagctgctgtatatgcagctgagagattccattttggcagactataaggacaagccatactattctcctttgccgggggagcgcgaactgtgcgatatttattctgtcagccggcctacagtcagaaaggcacttgaaatccttgaggatgaaggatgtatcataaggctgacggggaaaggagcgttttttatcggcaataaggagtttgtggatgcgaataatgatatgaggttctcagacattgctttctacaatcaggttagtctgaggggagactatacgagcagtaaggtcctgctgcagaagattgagattgcagataaagaggttgctgtgatgctgagacttcctaaaaatgccaaggtgtttcatctggagcgtctgaggtatatcaacggcaaattgtattctctggccaatgcatatattccctatgagctttgtcctgagcttacggaatatgatttttcagaccgttctctgcacaacacactttgtcagtacggtcatgtgccgtttaaagcggacaaaaccatagaaatttcaaaagcatccgagtatgatgccatgcatttagatctgaaacccggagacccgatttcaatttcttccacagtgacgtacgatgagcaggggaatatgctggaatatgcggtaacgagggccgatgcatataagactctgatacagatgcaggtgtataaccaggatcatgttaaagacaaggttatgagagagaagcgccagtagtacgccggcgcttttcaattcagttccatagatgaagccggtaatgaagtcattttgatgggaaccggactgggatttaaggggaaagaaggaaagctgtatgtttcagcaattttcgactgctttgatcttggcgttcttggtcttgcattggaaatgaacatgaaagcggatctgtgtgtccaaaccttggagaacgccttaactgcatatccgtctttggaaggagccattatacacagcgaccgtggaacgcagtatatcagtgaggtctaccgccagaatattcggaaacacggtatccatcaaagtaagaatagtaccggaggacgatgtcatgataatgcacgatgtgagagtatgtgggtacggttgaagacagaactcccctatgaccgttacgatgcaagagagatgacagtagaagaattaaaggtactcatctggagataccttctcagctactggaacaaccgaagaatctgctccgccaatggaggcctgtctcccatgttaaaacgcagacaatattatgcggctttgggacgggcagcatagtcagtgatatctttgagaaaaatgtgtcaactaatattgacaatatcagactaagcccattcattttactgttgactggctcagctggttttgccattttgcataaaaatgaacgtgcagggacgtgccacaaccttgcttttgcggaagtggtaagctacaataaagacaatattgaacgtgtggagcagaacgaaagccgacagcatgaccgacaacaaagcaggactaagcagagggaagaagaattgttgtgaaaattagaggaaaataacagcataataaaacagctccctaatgccaaaatcgagggcactgaaaaatacaggtctttcaaattataattttaaggacataagaaatccacttgtctcatgaaccgacccccaaaagttagaccaaaaatctaacgattgggaggtcggtttttagatggcaaaatatagtttcgaatttaagaagaaaatagtaaatgaacacttagaaggaaaaggagggtataaagaattaggtagaaaatactctattccctgggaaaatgttcggaagtggataaaaaattacgatgctaatggcgatgaaggacttacacgcttcagaaaacaatcaactttttctttcgaatataaacttcatatggtagagttatatttatcaagtgaggtctcatatcgggaattagctctctctcaaggtataaacaattcctccatgcttactagatgggtgaacaatttcagaattgccagtcctgatgctctgagaccaaagaagaaaggtcggaagaagtcattgaaaacaaagctaccgaaggaaactgctgagaaaaatagcgaaggaacgcctgtagataccagtgcagaacatataaaacagcttgaagatgatcttctcaagcttagaatcgagaatgcctatttaaaagaaccgaggaggctgcgtttagaagggaaagctcctctgaaaaaacagcgaggcggaattgcatttcgaccgttattcagataatatttatcaagaagttcatcgtaaataaagctaaaatcaacatatattttcatgtatcgacttaacaccaatctctgatgttgttcgatcataaaaacaccgcctatatttgatatatacattgtagcaaacacaggcggtattatctactttttcagtgtcctcccaaaatcacaaaggggagaaatgttagctcatatttacacgctttatgctacttcataaaaacgaatgtcgggttcgcctgcccaagttggcttgagtcctttaacgacatcattgctaaacatatctgtttcaagatatgcctttgcgtgttccatgctatcgaaaccatgaatgacctgaacatcttcgttacggataaggagttctttagttaatgccccctcaatggtatcaagaaacggttggcggtaatcagtgtatacctttgcagccgcagcacgattttcggggttgattttcattgtgatttcaagataagcttttacattcattgtacatacctccgtataattttgtgtttacatttttgtaacgtatacgaataatagcacagtggctaaagcaatagaagatataaagaaatttattagttactattaaatttattagttactaaacaataaaaagtaagcgtgatataatcaacttataaattttggaataagggggtatgcaaagtgtatcagaaaaaaatggatacggatataaggtgtcctttagaatacggattagaaatatttggaggtaaatggaaatctcgtgtgatatgtgtcctaaatgaaaaaggcgttttacgttatagcggcatccgaaaagaaatgatgaatattacagatgcggttcttgcatctacattaaaggagcttattagtgataatcttgtggaaagaacacagtatgatgaaatcccgccaagagtagaatactctcttacggaaaaaggaaaatctgttgttccaattttgcagagtatatgtaaatggtctggaatatttcataaagagaatagtggaaatattatgacacaatgtcaacagtgtgattataataattaaaccaatagatagtgtcaagtgatgtatgaaaaaggtgagcataaaaaataggattagatgaaccttgaaaactgtagatattgataacgttaagctctccgagggcttagggcagcgcccgaacccatcctcgccggaaggcaggaaaagggcgcagttgctccttttaggctgtggttcggttttgaagattcaggatcgtctgttggccaaggaatataagaagctgccacttgccgggcatgttttcggaagctctatcagagatccggatcgacaaagggtttgatgcaaagagctgcggatttacagtagttggaaatgttctgacgagagataatgataccgtaaaagtcatggagcgcctgcttagtttttctgagagagtttgatcatttcacacatgaacaagtcgcaaatccatttcgcatcctttcggtcggtcttatttcctttttgatgttttgtatattttggatgagcaagaaacacagaattattttccttttctaaaacattaaatacagggatccaatacttgccggtagattccatacagacttcagaacagttatactttgcaagccaatcacacagtttcttccatcctttggaaaactattgacagctgcattacgagacttcgtctggagattaaagatcaggatcaggtagatgagaaaaagatcaaatctgctggaattgcaggaatcatccgtccgggtaaaaacagtattcagattattgtaggaactaaagtccggtttgttgcagatgaattgataaaacttgctgaaaaataaattaagcgttatattgtaagtgattagggataacatatggggagacagcagttactgtttcccgcattatagaaaggaagtacaagatgagagttattaagggaaaagattacaatgacatgagcagaaaagcggcaaatattatttctgcagaaattatcacgaaaccagactgtgttttgggattggctacaggttcttcaccgatcgggatttatgaaaatttggtgcactggtatgagcaggacgatctggatttcagccaggtaacctcagtgaatctggatgagtacaaaggacttccgaaagaaaatgaccagagctatgactatttcatgcatgaatacctgtttaataaggtgaatatcaagcctgaaaacatcaacattccgaatggtatggaagaagattccgaaaaagagtgtgcaagatataatcaggtgcttgaggacttgggaggagttgaccttcagcttctgggtatcggacacaacggccatatcggcttcaatgagccgggagaagcatttgagaaagagactcactgtgtggaccttactgaaagtacaatcaatgccaataaaagattctttgagaaagaagaagatgtgccgagacaggcgtatactatgggaatcaaatccatcatgaaagcaaagaaaattcttcttattatcagtggaaaagaaaaagcaggcattgtaaaagaagcatttttcggaccggttaccccgaaagttcctgcatctatcttacagcttcacaatgatgtgattctggtagcagatgcggatgcgctgtcagaggttgaggatttattatgattataaagaacgcagatgttttttgtgaggacggggttttcaggacaaaagatatttgtacagacggtgaaaggatcagcagttcttcagagaatgatgagattctggacgccgaaggctgctatgcggttcccgggctgatcgatattcatttccatggctgtgtaggacacgatttttgtgacggaacagaggaagctataagagaaattgcttcttatgaggcagaaaatggagtgcttgccatatgtcctgcaacgatgactctgccggaagaaacactgatgaccatcgccaaggcggcggcagcctacaatggggacagcggagcagatctggttggaatcaatatggaggggccgtttatcaatgaggccaaaaaaggcgcacagaatccggcctatatccataaaccggatgtggcaatgtatgaaagacttcaaaaggcatccaatggtctgtttaagctggtggacattgcgccggaaactgagggcgcaatggaatttatccgtcaggttaaggatgaggcggtgatttcgatcgcacatacggttgcggattatgaaaccgcggtcaaagcgattgaacatggagtcagccatgtgacgcatctttacaacgccatgccggggtacagccacagggcaccaggggtaatcggagcggcatgtgatcacggactgcatgtcgagctgatctgtgacggtatccacatccatccgagcgccgtgagaacaacgtttaagatgttcggggatgataagatcattctgatcagtgacagtatgatggctaccggaatggaagacggaacttatcagctgggaggacaggacgtgaaggtggtcggcaatcttgctactcttgccgaaggaggcgcgattgcaggctctgcaaccaatctcatggattgtctgagaactgccgtcaagacaatgggaatcccactgaacagtgcagtaaaatgcgccactgagaatccggccagatccattggcatttatgacagctatggaagtatttcagagggaaaatatgcgaatgttgtcctgctggataaagacctggagatcaaagcggtcataaaaaagggagagatcctgaatcacaaataataaaagttatcaggtaccggagatacgcagaaaatgcggactccggtactttttttatttttaggacaggttttatgcgctctttctcgagtttggaggaaaatatatttagtatataaattgtttgtatacaaataatattggtaaaaactctttttttctttcttatatttgtgtataatagcccagtaggagaatacaatagtgatgaaaaagagatggatggcaatcgttcttatggcagtgctcatttggaatatggcaggaacaaatttagaaacccgaacggcctatgcagcgtctaaacagacaatatggcaaaaaaagttcagtcagtaccggtataacaagtcagtaaaccagctgatttttgtgaaatacaaaaagaaatcaaaagcaactgtctatatgtatcaaaaaagagatcataaatggaagcgcattttgaaatgtaaaggttatgtagggaaaaaaggaatccacaagaagagggaaggagatctgaagacaccttccggcacttttggattcacaggtgcttttgggatcaaaaaaaatccgggtgcaaagatgaattataccagagtcaataagtacctctactggtgcggggataaaaaatattataatcggctgatagacgtgagaaaaaagaagcaccgctgccgcggagagcatctgattgactataaatcacattattattatggaatgtttcttaattataatccaaaacataaatataaaaaaggatctgcaatatttctccactgtaaaggaaagaagccgtacacggcaggatgtattgcagtaagccggaagaacatgaagaagattataaaaaatgcggaagcaggagccaggatctgcatttatcgaaaataatactgaaagttaccaggaggaaagaaaaatggaatatgaaggaatggtatacagaccgccgagtgaggcatacagtctgatcatacaagcgaccatcggatgtagccagaatgactgtatcttctgcaatatgtacaaagaaaaaaggttcaggatgaggccgattcaggatgttctggccgacttcagagaggcaagagagtgctacaattcgatcggaaagatttttctggcagacggagatgctctgatctgtaaaaacgagtatctgaacgagattcttaaatatattcgtgaagaaattccggaatgccggcaggtcacctgctatgcttctcctaagagtgtcatgatcaaaacaaaagaggaactccgggaactgagagaaaacggtctggatatggtatacatggggctggaatcgggaaatgcccaggtgcttaagttcatgaaaaagggagccacgccggatgagatgatacagtctgcgtccaagataaaacaggcgggtatccggctgtcagtgacggctatttcggggctcgggggaagaaagctctggatggagcatgcggttgatacagggaaagttttttctgcaatgaaaccggattatataggactcctgacattgatgatagaacccggacttccgctggaagaaaagatcagaagcggagagtttgaactgatcactccttatgataatctgaaagagacaaaattgatgctggaacatatggactgtccgggatgtatcttccggtccaaccatgcatccaattatgtcaacttgagaggaactttgaatgaggacagagataaaatgatcgctaaacttgaaaaggcgatacagggcaatctgcatttgaaagaagaatggatgagaggattttaaatttttaagtgatagaaaaagaaggagaatgggtaaataaatacattttccttcttttttctattacagttttataaattccggtgtctggttctgaaagacggtatagaaccggaagccgagagaagtgaggagttcccggagctttggaaagtcgtatgccatatgttcgggacagtgtccgtcagagccgatcgtaagaatttctcctcccagttccaaatagcgtttgagaatatccggatggggattcggatatccgagcccgtacttatatccgccggtattgacctctatcccttttccgtcttctatgatggtttttaaaatttcttcgatcaaatcggcgtaatcctgatagacaaactgataatttttatcgggacaatagcgcacggcatagtccaggtggccatatacgcagtagtcatgatagactttgacattctggagtatcacttctaaatatcttaaaagacctttctttccaggatatgtttcaaaatatatgggttcatatggatccatttggtcaacaatatgagtagaaccgatgatgaaatcaaaatcatcagagtgggcaaagtcccggcacttgtcataggttgtgggcatcagtccgacttcggcgccaaataaaatctgtatccggtcattgtatttgtcttttaatgataataattcagatttaaatgaggggagatccaccagaaaatctaaattttctttattttcaggataatcaaaatcctgatgttccgtaaaacagattttgttgagagagagctctatggccctcaatatcatagattccattgaagcctgggagtcagatgagtgactggtatgtaaatgaaagtctgagtgaatcatggcgtctcctttatattttaaaaaatgataggttttaatcttattatatataattattaaaaaaaatacatgaaaatcagataagttacaaaagttttactttaaataaacaattaccttatgttaaactaaagatgtttaatacaggaggaaaaaaaatgaatacattagatcatctgggaaacctgtttgcctttgccggcggattaggtatgtttctctatggaatgaatgtgatggcggacggactgcagaagactgccggtaataagatgcggcagctgttgggatatctgaccaacaaccgctttttaggagttttagtgggagctttggtcacagccatcatccaaagcagttcggcaactaccgttatggtcgtaggttttgtgaatgcaggcatcatgaatcttacccaggcagcaggcgttattatgggtgcgaacgtcggaactacgatcaccgcatggcttgtgtcggcaaatgaatgggcaggggcactgaaacctgaattttttgcaccgctgatcttagccatcggagcatttattgtaactttttcaaataaacaaaagttaaatcagaaggcagagatcgccgtaggtttcggtgttctttttatcggactctcttttatgtccagttccatcggagtatatcagagcagccctattttcgcaaaggcttttgaagttctcggggggaatcctattttgggaattcttgtaggagctgtcgttacagcgatcattcagagttcttctgcatccgtcggtattcttcagacacttgccatgaagggcattgtaaactggcgttccgccgttttcattacgctggggcagaacatcggtacatgtatcacggctcttttatccagtgcgggtgcaaacaaaaccgcaaaaagggcggcggtaattcacttatcttttaacatcatcggagctgctatttatggaattatcatgaccattttcttcggagtgtttgaccatctggccatgcagcatatttcgagtacggagatctctattttccattctatcttcaatgtatcagtcactgtactgctgttcccgtttgccaatgtattggtgaaactgtcaggactgattatccacgaagaaccggaagatgaggaagacgaggaagtagaagagatggtgctgcgtcacctggatccgcgtatcctggagactccttcttttgcagtggaaaacgcagtcaaagaagtagtgcgcatgggtgatatcgttctgaaaaatatgaagcgtgttacgaaggaagccatgaatccgcagccgagtgaaaaacagctggacaaggtattcagggatgaaaaggtcatcaaccatttagaaactatgatcaccgggtatcttgtaaagatcagcaatctggcactgacggagaaacagagcaaaattgtcacggatttattctacacaatttcggatatcgagagggcaggagatcatgtcgaaaatattgctgaattcatgcagataaagcatgacgataaaattgcattttctgatcttgcaaaggacgaattgcacaaaatgacggctcaggtcattaaaacgtttgattatgccatcagggctattgagaaagacgatgtggaaattgcaaaacaggcaattcagggagaagaagaagtcgacagaatggagaaaaagtaccggaaacagcatattgaacggctggaacgggagtcatgcatacctgaagccggagtgatctatattgatatgatgacaagtctggagcgtatttcggactatgccgacaatattgccaattatatcatcgatgagaatgaaaaataaagcttttggtaatcttgtacaaagatatgattttgtatacatgagagaaatgctaaaatagacttgatatttttggacatattgtttaaaataaaaaggaagtttgtcaatagattgacaattgacagacaacattaaattattcattcaagacttaggaggaattgagatggcagtaaaagtagcgattaatggatttggacgtatcggacgtcttgcattcagacagatgttcggagctgaaggttatgaagttgtagcaatcaacgatttaacaaatcctaagatgttagcacacttattaaagtatgattctgcacagggaagatatgcattagctgacaaagtagaagcaaaagaatcttcaatcgtagtagacggaaaagaaatcgaaatctatgcagaagcagacgcaacaaaacttccttggggagaattagacgtagacgttgtattagaatgtacaggattctacacatctaaagacaaagcatctgcacacattcaggcaggagctaaaaaagttgttatttctgcgccagctggaaacgatcttccaactatcgtatacaatgtaaaccatgaaacattgacaaaagaagacacagtcatctcagcagcatcttgtacaacaaactgcttagcacctatggctgatgctcttaacaagtacgcatcggttcagtctggtatcatgttgacagtacatgcttacacaggagatcagatgactcttgacggaccacagagaaaaggtgatttaagaagagcacgtgcagcagcagtcaatatcgttcctaactccacaggagctgcaaaagctatcggattagttattcctgaattaaacggaaaattaatcggatctgctcagcgtgtaccggttccgacaggttctacaacaatcttaacagcagtcgttaagggagagaacgtaactgttgatggaatcaacgcagctatgaaagcagcagctacagaatctttcggatatacagaagaagaattagtatcttctgacatcatcggaatcaaatacggttctttatttgatgcaactcagacaatggttactgaaattggtgacggattatacgaagttcaggttgtatcttggtatgacaacgaaaactcttacacaagccagatggtaagaacaatcaaatactttgcagaattagcataatcatcagcgctgtggatgcggacaggcatcaatattcagtgtagtattctgcaataccatacccacagggcacactgtattttatgcccttcgggcagcgtgctttgcacgataaggtataaagactcaaatgggtccggtctttttggaccggacccgtttttttattttgtttgttaaagaaggcaatccggcaggataggcattcgatttaatcctataagaaatcccaggaggaaagaacatgttaaacaaaaaatcagtagatgatatcaacgtaaaaggaaagaaagtcttagtgcgctgtgattttaatgtaccgcttcaggatggaaaaatcacagatgagaaccgcctggttgcggcacttcctacattaaagaagctaatcgcagacggcgggaaactgatcctttgctctcacttaggaaaaccgaaaggagagccgaaaccggaattatctcttgcaccggtggcggcacgtttgagtgagttattaggtcaggaagtgaagtttgcagcagacgacaacgttgtaggaccgaatgcgaaggcggcggcagacgcaatgcaggacggagatgtcattttacttcagaatacacgttacagagcagaagagacaaagaacggagaagaattcagcaaggaacttgcaagcctctgtgatgtatttgtaaatgatgcttttggaactgctcacagagctcactgctctaacgtgggagttacacagttcgtagacactgcagttgtaggatacttaatgcagaaagagattgatttcttaggaaatgcagtcaacaatccggaacgccctatggtagccatcttaggaggagcaaaggtttcctctaagatttctgtcatcaacaacctgctggacaaagtcgatacattgatcatcggcggaggtatggcttatactttcatgaaagcactgggagaagaggttggagattccttactggaagctgactacttagactatgctaaggaaatgatggacaaagcaaaggaaaaaggcgtgaacctgctgatccctgttgatacagtagttgccgatgacttctccaatgacgccaacatcaagaccgtagagagaggcggaattgaagcaggatggcagggtcttgacatcggaccgaagacaagagaattatttgcggatgccttaaaagatgcaaagacagttgtatggaacggacctatgggatgtttcgagatgccgaactttgcggcaggaactatagcagttgcagaggcactggcagagattgatgctacaacgatcattggtggaggagattccgcagcagctgtaaaccagcttggtttcggtgataagatgacacatatttccacaggaggcggagcatctctggaattcctggaaggcaaagaattaccgggtgttgcagctgcaaatgataaataagctttttaactatcaaggaaagtaatcggagggtataccattatgcgtaaaacaatcgtagcaggaaactggaaaatgaacaaaacacctagcgagaccgtagctttagtaaatgaattaaagccattggtagcgactgaaacatctgatgtagtattctgcgtaccggcaatctgtattccggcagcgatcgaagctgcaaaaggaagcaacatcaacatcggtgctgagaacatgtactatgaagagagcggtgcctacacaggtgagatcgctccaaatatgctgactgacttaggtgtaaaatatgtcatcatcggacattctgagagaagagaatatttcgctgagacagatgagacagttaataaaaaagttttaaaagcttttgaacatggaatcactccgatcgtttgctgcggagagactcttgctcagagagaacagggtgtgaccattgactttgtacgccagcagatcaagattgcatttcagggtgtgactgcagatcaggcaaagactgctgttatcgcttacgagccaatctgggcgattggtacaggaaaagttgcaacaacagagcaggctcaggaagtttgtaaagcgatccgtgagtgtatcgcagaagtctatgatcaggcaaccgctgatgccatccgcatccagtatggcggttctgtatctgctgcaagtgcaccggaattattcgcacaggaagacatcgacggaggattagtcggtggagcttctttaaaaccagactttggtaagatcgtaaactacaagtagagagataaagctgctgcagaaattatttgcagcagctttttacttaaaatcggtttaaaggaaatgagagtaaggatatgaaaaagagatatataataatggcattttttatgattgcaggcttatttaattgtccttcagtttatgtcaagaaagtcgaagcaaagggaaagacttatacaatcagtccaaataaaattcctaagtccgttaagaaatcttctgcctacaataaaaacactaagaactcacttcaaatgcaatattatctaaaaaaactgcaaaaaggaggtggcagactggttctgaaaaaggggacatataagatctgttcgactctttttgtaccttctaatacaacaattgaacttaaagaaggtgcagtattaaagaaaataaacaaaggtaaaagcaactacaagcctacaaaaaatatgtttttgctttgttcttacaaaaacagaaataaaacaaatgtatataaaaagtataacggaccccaaaatattaaatttataggccacggaagtaagtcaattatcgatttatcttatataaagggggcacatggagtatctggttctcataatcagaatgtaacttttcagaatataaccttcaagggacagaatggagggcattatattgagatcgccggagtgaaaaatgtaactataaaagataacagatttctttctgccaaatccagtacaaggagttcagcatataataaagaagcaattaatatcgatacaccagataaagcgaccggtggatttacactcaggtggagcagaaaagaccagactccgaatgtaaatgtcatgatcaataataatgtatttgacggagtgaaccgcgcaattggaacgcataaatactcacaaaagaaagacaaaaaagggaaatattcaaagtcttcagtaaatgtttatcatcagaggattcagattagaaataatcagtttaaaaacatttatgataatgctgtctttatgatgaattgggaaaatacgacgattgattcgaatcagttttcaaaaattggtttgaaaaataaaagaaatactaatacggcaaaacatggtgtggcaggaggcggcatcagaaagctgacactcacaaataatcgttttatacaagtgagaagcagcgtcgtatatttgaggagaactgctaataacggttcaggaagtaaatattatcctcttcttgtttatgtaacaggcgctgagctgcagaaaatggggagcaattctgccttgaactgcagcagagatcctgtttatccgtcttatgacattctaatgtttaaaggggacggtaatcgttccagagacaatgcttacggaatggatttaaagagtggaaaaataatagccaggataaaatagtctacagtcagactcaatctgttattgaatttataaacaataatcgttataatattaacggattataaattgacagccaatgaagataaaggagataataatgagcaagaaacctaccgttttaatgattttagatggttacggattgaatgataagaaagaaggcaacgcgatcgcagcggccaatactccagtcatggacgaactgatgaaaacatgcccgtttgttccgggaaatgcatccggtatggcagtaggccttccggaagggcagatgggaaattctgaagtaggacacttgaatatgggtgccggaagaatcgtataccaggaacttacaaggatcacgaaagagatccaggatggagacttctttgagaacgaagcgctgcttcaggcagtagaaaactgcaagaagaatggaagtgcactccatgcaatgggattagtatctgatggcggggtacatagccacaatacgcatctgtatggattattagaactcgcaaagagaaataatatcgaaaaggtctatgtacatgcattcttagacggacgtgatacggcacctacttccggaaagggattcgtagaagaactggaagcaaagatgaaagagatcggtgtaggcaaggtagccactgtttccggacgttactatgcaatggaccgtgacaatcgctgggaccgtgtggagaaagcatacaaagcccttgtcatgggagaaggagtaatgaaagattctgccgtggatgcaattgcggattcctacaaagaggaagtaaatgatgagttcgttctgccgactgttatcacggaaaatggagagccgactgctgtgatcaaagaaaatgattctgtcatcttcttcaacttccgtccggacagggcaagagaaatcaccagggcgatctgtgatgataagtttgacagctttgagcgtccaaacggttactttaagacaacttatgtatgctttacagaatacgatgctacagttccgaataagctggtggcattccataaagtagagattaaaaatacattcggagaattcctggcagaacagggattgaaacagcttcgtctggccgagacagagaagtatgcacacgttaccttctttttcaacggaggcgtagaggttccaaatgaaggagaggagagaatccttgtgaaatcaccgtctgtggcaacttatgacctgcagccggagatgagcgccatggaagtgggcagcaaacttgtagaggctattgagtccgatcagtatgatgtgatcatcgttaactttgcgaacccggatatggttggacacaccggcatttgtgatgcggcagtaaaagctattgagacagtggacggatgtgtgggcagagcggtggaagccatcaaaaaagcagacggacagatgtttatctgtgctgaccacggcaatgcagagcagctggtggattatgtgacaggagctccgtttacggcccatacgatcaaccaggtaccgtttatcttagtaaattataaggaccgtgtgaaattaagagagggcggatgtctggcagatatcgcgccgactctgatcgaaatgatgggacttgaacagccggaagacatgaccggaaagtctttgttagtaaaataaatatcgatatgacagaaagcagtgtgtgtttaaagcacactgctttctttttgtatttcaatgtatggattttcatctatctggataaaatactactaattacttgtaaaggatgtgaatgtgttgaaatatggcttgtcaatagaagatgttataggaagagaagttttggactccaggggaaaccctacggtagaagtggaggtattgctgtccaatggacattttggaaccgcactggtgccgtccggagcctccacgggcaaatttgaggcgatagagcttcgtgaccgcgagaaacgctacggagggctgggagtagaaacagcagtaaaccatgtgaatcaccggatcgcagaccggctggtgggaaaaaatgcactgaaccagattgaaatcgatcagattatgattgaagcggatgggacagaaaacaaagaaaagtttggggcgaatgccatcctcggagcatcactagccactgccagggctgccgcaaacggattgggacttccgctgtatcagtatttagggggaagtttcgcgtgtaagctgccggtgccgatgatgaacattttaaacggaggaaaacatgcagataacacagtggattttcaggaatttatgatcgctccggttggagccgaaacgttcaaagaagcactgatgatggggacagagatctaccataagttaaagagtattctgaaagaaaaccatctgagcaccggggttggagatgagggaggatttgcaccgaacctggaaagctcggaggcagcattggacctgctggtaaaagcgattgaaaatgcgggctataaggcaggggaacagatcatgattgccatggactgtgctgcgtcagaaatttataatgaagacgaggatgtctattatttcccgggtgagagccagatgaccggaaaagagatacggagaaattctgaagaaatggttcaatattatgagcagctcaccgatcattacccgattttttccattgaagacggattaaacgaggaggatgcgcccgggtggaaagtactcacatatcgtctgggagaaaaaatactcctggtaggcgacgacttatttgttacaaataagaaacgtctgacagacggtatcgagaatgatatggcaaacagtatcctgatcaagccgaatcagatcgggacactgacagaaaccctggatgccatagagactgcaaaaagggcaggatataaaacaatcatatcccaccggtccggagaaacagaggatacaacgatcgcggatattgcggtggcgacaaacagcggactgattaaaacaggagcgccctgccgttctgaccggacagcaaaatataaccggttgctgagaattgaagaagaattgggtgcctgtaagcgatatggattgtatttatagaacgataatagtataaagaaagaaaaaatatttcattgtggaaggggcggaagatgagaaattataaaaaagttttatcgtggatcatggcagtctgcctgcttctcacttggaatatttctgtatatggagaacagacctcagagaaaacaggacagcggagcaacgttgtcctgtttgtacagtttccggaggatgaaacagatgatttttttaacacccaccaggagagactaacttatgacaaaggctccgagcctctgacaggctttgcggcatatgagcggattttaaatggcagaggagaacgtaaccgttcctcactatccatttacatagatgcagtttcagaaggaaaattgaaaattaaaaatgtgtttcctcagtataacgatgccaaaattgttcccatcacaatggaacacagcgtggattattatgacagctatgcaggagaagccagattgtaagacgaggcggtcagtaaatcagggaaatataaaaaagtgaaggagacatcccgagaagaaaaaaatcaatccagaaaagaagtagcggttccgtctgaaaggttttcgtaaaatcataggaaagcgtatctatacacagatccctgtcaaggaaaagtaagatttgaacgtatccttgcattttatggtaaggtgtgctagaataatcagcagtgagcagaaacattaggaggaagaagcaatgaagacggcattaactatattatttttaatatcgtgcgttgttctaatcatattagtattgatgcaagaaggaaaggaagctggattgggatcactgacaggatccacaacctccggcacatattggagtaaaaacaaaggccgttccagggaagggaacattattaaagcgacaaccctgtttacagtcatcttttttgtgacagcagcgctcctttgttccagatttctttagaatggaaacacttctttaagcagataatgtttaagaagtgtttttttattccacaggaaagttctgcgaaccttcctgtagaatgaaaaatgctccggatagtacagcattgttgcagaaagtaaaggaaagataatggaaaaggaattgtttgataaaagaaaaaaaagaatcagagatctgatttatgataaacactatcatcctatgaaacaaaaagagatcggctatttattgcaggtagagccggaagacagaaaagagttcgtccagattcttcatgaactcgttgatgagggagtcgtggaagtctctaagagaggaaaatacagcccggtgtcaaagaagacactgaccgggacgtttgtatgcacccagaaaggatttggatttgtttcggtggaaggagaagaagacgatttttatatcaatgaaaatgatatgaacggagctttccatgaggatactgtgcagatcgaagtgactgaggaacgggccaggaacggcaggcggaaagaagccagaattgtaaaggttctggaacggggaatgacggaaatagtcggcacatttgaaaaatgtaaaagctatggatttgtcgttccggacaacttgagatttgacagtgacattttcattccgaaagaggaatgcggaaatcttaccgatggatttaaggtcctggtaaagattgttgactacggagatttaggaaagagtccggaaggcaggatactggaggttttaggccacagggatgatcccagagtggacattttatcgatcgtaaaggcatacaatattcccacggagttcggggaagaagtcaaaaaagaagtgggagcagtgccttcggtcatagaaaaatcttcgctggaagggcggctggatctgagagactggcagacggtgaccatagacggagaggatgccaaggaccttgatgatgcgatcacgctgaccaaaacatcaggcggctatcagctgggagtccatatcgcagatgtctccgattatgtgaaggaaaactctgcactggataaggaagcgctgaaaagaggtaccagtgtctatctggtggaccgggtcataccgatgctgcctcatcagctttccaacggtatttgttctctgaatgcaggtacagaccgactggcattgagctgtatcatggatcttgacaaggaaggaattttaaagggacaccgcattgccgaaaccgtcatccatgtggatgaacgcatgacatacacaagtgtggcactgattctggacggcgatgaaaaagagcggaagagatatgaaaaacttgttccgatgttcgagcagatgaaagagctttctgatattctgcgggaggtgagacatgaacggggaagtgtggactttgattttcctgaatcgaagattgtgctgaacgaatacggaaaggcagtcgacgtgattccatcccaaaggaataaggcaactaagatcatcgaggatttcatgcttcttgcaaatgaaacggttgcagagaatttttactggcaggaaataccgtttgtgtaccgtacccatgacaatccggacggggaaaaagtcaagaaactcaggacgtttctcgagaattttggaatcgtactgaagcttaaaaaagatgaaatccatccgaaagagatacagaaacttttgacaaaggtggaaggcactccggaggaggctctgatcagcaggctcaccctgagatctatgaaacaggccaggtatacaaccgagagttcaggacatttcggattatctacaagctattactgtcactttacctcaccgatccgaaggtatccggacctgcagattcacaggatcatcaaagaaactcttcggggaaaactcgatgccaaaagaatccggcattatgagtctattcttgcgaaagtctcagagcagtcgtctaagatggagcggcgtgcagatgaagtggagcgggaagtagaaaaactgaaaaaggcggagtatatggaacgacatatcggacagcagtacaaaggcgtgatttcaggagtgactggctgggggatctatgtggaacttccgaatacgattgaaggaatggtccatgtgtccaagctgcccggggattattacaattatgatgagtcgtcctattctatgacaggagagaggacagggcgtaagtggaagctgggacaaccggtagagatcgttgtgaccggagtcgataagattttgaagaatattgattttgagattattgaggaggatgaacatggcgaagacgggcggaacaaagctgattgcgaataataaaaaggcacgtcatgattattttgttgaggagacggttgaggcaggcatcgtattgtttggtacagaagtaaaatctatgaggcagggacactgcagtattaaggaagcctttataagtattgaaaatggagaagtttttgtgaaacagatgcatatcagcccttatgagaagggaaatattttcaacaaggaccctctcagagagaggaaacttttaatgcacagttccgagattaccaggatgatgtcggaagtaaacagaaaaggttatacattgatccctctgcgggtttatttcaaaggcagtctggtaaaagttgaaattggactgtgccgcggtaagaaattgtatgataaacggcaggatattgccaagaaagatcagcagagagaagcgatgagagactttaaggtcagaaatctgggttaggacaatggaacggcgctttcttccgagcatactataattacaaaaagacaggaggacagtatgcacagaaggaagggtattgacgtaagctatgccgacggccggattgactggagaagagtcagagaagacaggatagaatttgcaatggtcagggccggattcggcgatggaaatatagatcaggagtttgaacggaatgcaagagaatgcaatcgtgagagaatcccactcggaatctactggttcagttatgcatatacaagagagatggccagaagagaggcaaaacaatgtgtcgagatcatcagaaggtatcgggttgaatatcccgtggcttttgattttgaagaagattccattgattatgcgagggaacagggtgtcacgatcacaaaagatcttgcaacagactttacaagagagttctgcgatgagatccgaagagccggatacaaacccatgttttacacaaatctttctgatttagaggattattttgatatccgccgcctcagggaatatgaactttggctggcgaaatatcagcatgttctcggagtggacgatgttgacatgtggcagtattccgattccggaagagtcagaggcatccggggcgaagtggacatgaattacagctttaaagactatgagaagagaaatccaacggataggcataggctctgtccggagacaagacgagaggaagaataaaagctccccattctgtatgtgccggagacaggtttatacagaatgggtttttgttctcttttgatgagttgtctggcatcattttaccacaatcattcagaaccgtgatataatatcactgcttgttttggtctacacagtggtttaacatacaatccatttctttttattgactttttcacaaaaaaagggttatactatataaggaaatattcgggctagtactggtttcgacagggattctgaagctcgggaagccattcggagagaccacgttacggtgtaaacttaaattaaacgcagataataaattagcgtacgctgcagcctaagggcagcagtagtctgtgacaggtcatctacagcctgtcattaggcttcaaataatgtagaaccctcgtctgtttaagctttgcggcagatgaagtatttatgaagctactgaagtactgatcctgtctctgggagcagtacggagggaatgtcaatacagagactgtaatgggagatgcctgaggggatgggtttttggacgcgggttcgattcccgcctagtccatcgcaaggagcgcgtgtttacgtgctctttttttgaatgatactaggaatgaataataaaaaaagaatggcttagatatgtttgaaacacataaataagccatttttttattttcttctttttgtttgagaagctggttagtagcagactttgcagggcctgctcttaggacaggaagacagggagccgtgataaatggtccgggaacggcccagggtcgggcagtctatggtgctgtgatatacagaccctccgggggtccaataaactgtttctgtatgtttcttttttgaagacttctttttaggagaaaccttaatcctgcaggttgcttttttgccggacttcatagttactgtgattttggcagtgccttttctttttgcttttacttttcctttctttgagacagtgacaatttttttattgctggatttccatttctttacggagtcaccttttgcgtattttattttcagtttataggtttttgagacttttaattttacggttttcttcgtaaactttacatacggttttaattttgcagtcttctttgactgtattttataacattcaagacactcgcgctgtttcagccctgttttacggatggttggtttttttacagtataccagtcatcccataagtgctcacccgttgcagggacagttttagtctggttttcatagcaaagataacaccagcgcgatttctctccagtatcactgcatgtaggttcagtcgtagtatcccattcactccactcatggtgacaagactcggctgccggaatcgtaagcgttggtattatcatagagaataccagaatgatacaaaacaatttctttttcataaatataaaccacctttctgcgaaaggcaccgatggggttatgaaaccctgtcactacttttcgcttttcaattctattccccttctgataaaatttcttttataaaaccgacacactacagaacacgtggaggtgagtggcggggctgtatagcggtaacctcgcataaatatatgtcgtcggtcatccgttaaggcatcaatgaatggcgcatttcgtagcccgtaaacttatctcttccaaagtcgactcgattttgccggatgaccagtccctgtcggttttatctcaataaaattcaggaggttattttattgtctttctaaatttttcgttttaactgctgtggacttgatgtccacaaaacctggatctacgcatattcgtcatttaagggatttagcaagataccggttcaaactcacctgtatgattaccggcgaaaagaaccgtgcgcaaaactgtcttactgtttctaatcttaaattagatgatgtattcagtgacgtgtttgggaaatcttctcgttccatcacagaatatatgctcgctcatccaggggaaatatttgatgtggcaccttttgtagacagtcgatgtaaaacacctatggaagaaatccaagccgctgttgacggagctatttctcctgagcaggccaataaacttcgtcagtgcctcaatcatatcgacgaatcagaaaagcatctggaagaaatagaacgggaaatccttcgtctctctgataaataccaggccgctcttgatctaattcgtacagttcccggatttgataaaaatccaatgactgccattcaaatcctttctgaaatcggaggtgacatgtctgttttcccctcagctaagcacctcgtttcatgggcaggatgttgtccgcgcaatgaccaaagcaacaaaagaatcaaatcaactcgaatttcccgtgctggtaattatattaaacccattctggtacaagttgcaaatggtttattgcgttctaagaaacatcctgaaataaccggccgctataagcgtattaaatcgcaccgtggtcacaagaaagccattatcgcaatctgccgtatgctcctgaccgctatctggcacatactttcagatttaaaaccatatacagcagaaggttttcttgaatcacgtcctgtgaataaagcaaaagtattgactacttcacaggcacttaatctactaaagcagcgtggatacaccattaaggatgatatcgttcctgccatgaattaggtgttgtgtctatattttctttttgaagccaccgtaagatggcttgtttgccatacaatttacttttttctaaccactattactttgtttcaaacttacctcctctttgttaagtataaagttactttctacttgtgcatacaattgatgacaatatatattaatataccacaattaatgacaaaagttatatataacatacaaaataactaggaactttacaaaacttatattataattacaggatcaaaaggctttgtaatataatcatccgcgccgagacgaagcagatcaattttattctgagtcgttccccgggcagaaataacaatcacgggaagatcagagcaggaacgtatttctttcaggagctgatcgccgcttttatatggaagcatgagatccaggagtaccagatcaatgttttggtgtctgatgatttgagaaatacagcggccgtcagtttctcaaacggcttcaaaaccgtatccggataaaaagtctgacagaattttcaggatttctttgtcgtcttcgatgattaatattcttgacatatacagtacctgtcctttcactaagtttttaaatagtatatcatatttttaggttgcatatcttttgccgtttatttaaaatattcataaggaacaaatacccgggaggataaatatatgaaatttacaaagagactgctttctctgctgctctcattgctgctggcattttcactgagcggctgcaaaacatcaacagagcagggaaaaagcggacaaaccagtcagaagaccggccaggaacagtcaaaaactgaggaacaaaaacagtttgacaaatttttagaccgacaggtaaaagagacgttgtctcaaaatacgctgaatcttcattatcagctgaaggatcctgagaagtatgggatcaaacaggagaaggtttccatcggacatatttctcccggacaagataagaaagcactgaaggaaaataagaagacagcagaagaactttccggatttaaaaggagcagtctgacagaaaaacagaaacttacgtatgatatattagaagattatctgggtatgctcatagaagaaagccggtatccattatatgacaatattatcggggagatttccggcattcagtccaatcttccggtgacactcgcagaatatcaattctacagaaagaaagatattgaagattatcttagcctgctgtcacaggttacaggatatcttcaagaggctggagagtatctgaaagcacagtctaaagcaggattgtatgtaaccgatgtggcagcagacactgcggctaagcagattggtgactttttaaaggaaagcggagaaaaaaatattttaagcgctacatttaaagaacgtgttaatgctgtttccggcctcagcaaggaacagaaaacaatttataaaaaacaaaataagaaactgctgaatcagtctgtgtatcctgcattccgcagttttaaaaagacaattctgtcactgaagggaaccgggaaaaacagcggaggtgtctgcaatttaaaaaatgggaaaaaatactatcggctggtcttgaaggagcagacgggaacaaacaaaacagtcagccagctgctctcaagtgtgacaggccgtctccagagctcagtgaaacagatggtgaatctgatccagggcgatgagagcctccagaaaaagttttataattttgatccggtgctgaccagtcccaaaaaggtattggctgatctggagaaaaaggcaaaaacagattatcctccgttaaaaaaagttcattataagatcaaatatgttccaaaggcgctggaagatactttaagtccggcattttatatgattccgccgatcgatgatgagacagaaaataccatctatatcaacaaaggctccactgataagagcggaatttacaatactctggctcatgaagggtatccggggcatctttatcaaaacaattattttctcagcacagatccggacgatatccgtttgatcatggattttcctggttactcggaaggctgggcctcctatgtggagatgcatgcctttgactatgctccgtatgataagtctgtggccaaattgaaacgcatcaatgacgagatcaatatggccatcggaagtgctgtcgatatcaatgtcaactaccggggatggaccctggaccagattaaagacatgctggaagacatgggatatggaagttctgcggcagaccagctttacaggctcgtatcttcggaaccgggatactatctgaaatattattccggagccctggaatttcaggaattgagaaacaaggcgtccaaggagcttggcaagaagttccagacgaaagagttccacaaggtgattcttgaaaacggcccgagcaattttttacaagtgagaaaagccgtagaggcatatatcgaagaaaacaaataggaaggaatacagtttattatggaagatatattacaggtaggagcgatcgcttccacccacggtgtccgcggagaggtcaaggtgtatccgatgaccgatgatgtggagcgctttaaggatttgaaggaggtactgctggatacgggcagggaaatgaagcttctgcatgtgaagtcctgtaagttttttaaaaaccagccgattcttaagtttgaggagtttgacaatatcaatgatatcgaacagtataaacgctgcgggctgtttgtcacaagagagaatgcagttaagcttgaagagaatgagtttttcattgccgatatcatcgggttcgatgtttaccgggagaccggaaagaagctgggaatattggatgacgtgcttcagacaggggcaaacgatgtgtatgtggtaaaaatggatgatggaaaggaagtactgcttccggccataagagactgtatcaaaaaggtctctctggaagaaaagagaatcgatgtttttgtaatgaaaggactgctggatgaataagtttcacgttttgactttatttcccgagatgatcgagagcggatgcagcacgagtattttaggccgtgcgaaagaggcgggacatatcggtgtggaagccgtaaacatcagggattttacgagggacaagcataaaaaagtggacgattatccatacggcggcggtgccggaatggtcatgcaggcggagccgatctatctggcatatcagcatatcgagcaaaagatggagaagaagccccgggtgatttatgtgactcctcagggaaaggtgtttcaccaggagatggctaaggagcttgcagaggaagaagaacttgtttttctgtgcggccattatgagggcgtggatgaacgtgtcttagaagagattgtcacggattatgtctccattggggattacgttttgacgggaggagagcttccggctatggtgatgatcgacgccatctccagactggttccgggagtgctgaataacggagactcggcggagtacgagtcttttgaaaacgggatgctggaatatccccagtacacaagaccgccggagtttttggggagaaaagtaccggaggtgctgctttcaggtcaccacggaaggattgaagagtggaggaaagagcagtcttatttgaggacaaaggagagaaggccggatctgctcgataaaaagtaaataatccttgcaaaaaaaaagttgttgtgatattatatagcagttgttatagataggatggtcctctgttacgcaaggtattatgaacatctaaaaagttttaaggaggaacaacatgaacgatatcattaaaagtattgaagatgcacagttaagagaagttgcagatttcagaacaggtgacactgtaaaagtatacggaaaagtaaaagagggaaaccgcgagagaattcaggtatttgaaggaactgtcatcaaaagacagaacggcggagcacgcgagacatttaccgtgcgcaaaaattccaacggcatcggcgtagaaaaaacctggccggtacactctccgatcatcgagaagatcgaagttgtgcgcaaaggtaaggttagacgcgcgaaattatactacttacgtgaccgtgtaggtaaggctgcgaaagtgaaagaaagagtataatatttttcaaaaaaacacagggacgagccggagcttgtccctgttttgtttaaagaaagggtgtgagatctgtgagcggatatacggttacttatcagatgaggaagaaaaaaagacagagacgggataagatcgcggcatatgtgctgacttttgtggccgtgatttttgcggcttttatcattgtccgttttctgtgtgccggttatacggtacagggggattccatgcttcccacctatgagagcggagaaaagcggctggtcaaccggctgatttataaagtgaaaagtccggcgcgatatgatataatattgttcgagtcagaggacgagacaaacaagcagtattatgtaaagagagtggtcggactcccaggagagacggttcaggtcagggacgggaacgtctatgtagacggcaggaaggccaaaagcttcggaaaagaacagatcctgtctcccggactggcagcagacggcgtaaaactatccaagaatcaatattttgtcatgggagacaattacaataacagcgaagattccaggagtgccgtagtcggcaatgtaaaaaagacacagatcataggcaaggtcgggatcaaatattggccttttggataaagaaggaggacacatgcagtttcagtggtacccgggtcatatgaccaaggcaaaacgaatgatgcaggaaaatataaagctgatcgatattgtgattgaactggtggatgcgagaattccattcggaagcaggaatcccgatatcgaccagctggcacagaacaaatccagactgattttattaaacaagacggatcttgcagacagcaggaagacagaactctgggaacggtattttaaagacaggggattctttgtcgggaaagtcaattcccaaaagggaaccggagtcaaagctgtccagggcattgtcatggaggcgtgcagagaaaagatcgagcgggaccggaagaggggaattaagaaccggccggtccgcgccatgatcgcgggaatcccgaatgtagggaaatctacatttatcaacagtctggccggaaaagcctgtacgaaaaccggaaataaaccgggtgtgacaaagggcaaacagtggattaaactgaataaaaatatcgagttattagatacaccggggattttgtggcccaaatttgaggatcagaccgtaggccttcatctggcattgatcggttctattaaagaagaaatattaaatcaggaagagatggccatggaactgatcccgtttctggtaaaagaatatccgggtattttagcggcacgctaccgggttgaagaggacaagaatacactgaaaatccttgaacagatcgcggctaaccgaaattgtaaagaaaaaggcaatcagctggactatgaaaaggccgcacatatcctgctggaggagtacaggaacggaaagcttggaaagatcacgctggaagtacctgctgactatgaggggtaatcaaacacatgtcgtttcgaataaggcgcagggcgcatcgtttttattctgaattatgtttctggggatccactgtttttatcgcagtttttgtctcctttcttatcattacctttataggagagaggaccggggtttccggccattctatggagacgacgctccaccatatggacagcgtactggttgacaagctgacttaccggttccgggacccgaagcgctttgaagtcgtggtatttccaaatcccgcagacagaaaagaaaagctggtaaagagagtcatcggaatgcccggggagacagtggagatccgcagcggcacagtctacatcgacggccggataatatccagggattattccaaagatcatatgacatttcccatcaatgtggagggcagcattaccctaaaaaaagacgaatattttgtactgggagataaccggaataacagcatggacagcagggacatccgcgtgggtcccatatacaggaaagagatacagggaagggttgttttcaggctgtttccgctcaaagatgcgggaagaatcttatagagaggcacttatgacaaaacaggaagaaaaacggatagaaaaactgaagaaagaaaagcagcgcatgtatgagatgttttcttatgagagagaatatgaaaggtattctcatatatgcgggattgacgaggtgggccggggaccctttgcgggacccgtggtggcggcggccgtcattctgccgagagactgtgatattttatacctgaacgattccaagaaggtttcaccgaaaaagagagaagcattgtatgatgaaatttacgagaaagctctcgctgtcggaatcgggatggcttcggaaaaagtcatagatgagatcaatattttaaatgctacctatgaagcgatgaggacggcggtttcaaatcttccggtcgagccggatctgctgctaaacgatgcggttacgatcccggggatcggaacagagcaggttccgatcatcaagggggatgcaaagagcgcttcgattgcggcggcaagcattgtggcaaaggtgaccagagaccggatgatggaagaatacgatcagctttatcctcaatatcagttcgcaaagaataaaggctatgggacaaaggctcatatcgaggcgatcaaagagtatggtatctgcacaattcaccggaagagttttgtaaggaaatacatatgaaaaatcatagaaagaccggtatggagaaggaagagactgcgtgccggtttttattgactcaggggtatgaagtcattgagagaaatttttattcccgctatggggaaattgatattattgcgcgggatgggcagtatcttgtgtttgccgaggtgaaataccggcggtcaacagccttcggatatccaggagaggctgttgaccgcagaaaacagcagaagattcataagacggcggaatattatttgttttgccgcggcatgtttgacaggccggcaagatttgatgtggtagaaatcataggaaagaagatcagggtgataaaaaatgcattttaagagattaaacgataatcattccacggtgctgcacgaagggcaggtgccgtatctaacgtttagaaaactgaatcaggccggagtccgccatggattttccaccaggatgggaggcgtcagtcaagggatgttctcctctatgaatttaagctatacaaggggagacgatgaagcctctgtggatgaaaatttccgcaggatcgggcaggcaatagggtttgacgagaaaaagcttgtattctccaatcagatccatgacacgaagatcgggagagtcgggaaagaagactgcggaaaagtcatgaccggaatggacggactggtgaccgatgtgcctggagtccctctgtatacgggatatgcggactgtgtacccctgtttttctttgatcctgtcaaaaaagtggcggctctggcccattccggctggaagggtacagtcggacggatcggagaaaagatggtaaaacagatgaaagacggatatggatgctgtcctgaggatattgtggcggctgtcggcccgtcaatctgcagagactgctatgaggtcagcgaagatgtggcagagcagttcataaaggaattttcaacacacccgaaagaagaatttttggacaggaaggaaaatgacaagtatcagctggacctgtggaaggccaatgagattatattgacggaagcaggaattttacaggagaatctggacatcaccgatctctgtacctgctgcaacagcgattacttattttctcatcgggcaacaaaaggaaaacgggggaatttaggggcattcattgtgctttgaatgtgatataatctttacaacagggaaagattatcatataatcaaacggaagttttaggaagaaagattccatacagagaggaaataaacatgagtaaaccgatagtagcaatcgtgggaaggccgaacgtggggaaatccacactgttcaacgcacttgcgggagagaatatttcaatcgtaaaagatacaccgggagtgacaagggacaggatctatgcggacatttcctggctgaattataattttacgctgatcgacaccggtgggatcgagccggattcgggagatgtcatcctttccaggatgagagagcaggcgcagattgccattgagactgcagacgtgatcatttttcttgtagatgtgaggcagggattggtggatgcggacttccaggtggcggacatgctgagacggtctcagaagccggtggtcctggcagtgaataaagcagacaattatgagaagtttctgccggatacctatgagttttataatctgggactgggtgatccccatccggtttccgcaaattccaagcttggattcggtgatctgctggatgaggtcgtggaaaactgtgatccaaaggctctggaagaggaagaagatgaaaggcctaagattgccatcattggaaagcccaatgcaggaaagtcttcgattatcaacaagatgcttggtgaggagagagtcattgtatcggatgttgcgggaacgacgagagatgccattgacacggtcatccagaagaacggaaaagaatacgtgtttattgacaccgcagggctccgccggaaaaataaaatcaaagaagatctggaacgttacagtgtcatccgtacagtttccgcagtggaacggtgtgatgtggcggttctggtcattgacgccacagaaggcatcaccgagcaggacgcaaagatcgcaggcattgcccatgagagaggcaaggggatgatcattgcggtcaacaaatgggatctggtggagaaagacgacaagacgatctataagttcacaaacaaaatccgcgaggttttggcttatatgtcctatgcggaattggtttttatttcggcaaagaccggacagcgttttcctaagatctttgatatgctggatgccgttattgaaaatcacgctatgcgtgtccagaccggagtgctcaacgagattctgacagaagcagtagcgatgaaacagccgccgtctgacaaaggaaaacgcctgaagctctactatatgacacaggtatcggtgaagccccccacatttgtggtgtttatcaatgacaggcagctgatgcacttttcctataccagatatattgaaaaccagatacggaatacgttcggattccggggaaccccgatccacatcattgcgcgggaaaggaaggagaagtaatggtcctttgtgtttttctctgcctggccatgggatatctgctgggctgtattcagacaggatttattatcggaaaaatcaatcatatcgacatcagagattacggaagcggtaattccggaacgacaaatacactgagaacccttggaaagacagcggcactgctgaccttccttggggattcctcaaagggactcatcgcagtcaacattgccagatacatattaattccccagttcggaggaatggcccatgaagccacactctggctggtgaccgggtttgccgtggtcatcgggcacaattttcctttttacctgcattttaaaggagggaaagggatcgctacaacaggcggcgtgatctttgcattcgactggagactgggacttctctgtctgcttattttttctgttgtgacagggatcagtaaatatgtatcactgggttctatctgcatggtactggtaatcccgtttattttatatttcagcagtccccacgactggcagcttgtggcggtggggtgtgtgtttacggctatggcggtctggcgccacagggcaaacattggccggctcattcacgggacggaaaacaaactcggacagaaggtaaaacgttaggaggaaactatgaaaaaggttagcgtaatcggtgcaggaagctggggaagtgccctggcagttttgctggcgaacaatggacatgaagtgacactgtggtctcacgattccaaggagatcgagatgcttcagaaggaaagagagcagaaagacaagcttcctggagtgaagcttccggagaatataaaggtcagcgccgatcttgaagaaactctcacaggcagagatgtcatcgtcatggctgtgccgtctccggtggtccgttctatggcaactcgcatggctccatttataaaagaaggccaggtcatcgtcaatgtggcgaaagggattgaggatgaaacctataagacactgacagagatcatcgaggaggagattccgggcgctgttgtctgtgtactctccggcccgagccatgcagaggaagtgggaagaaaactcccgacgacctgtgttgtcggtgcaaagaaggaaagtgtagctgtaatgcttcaggatctgtttatgaatgaggtgttccgtgtctacacaagccctgatatcatgggaattgagctcggaggagcattgaagaatgtcattgccctggctgccggcgtcacagacggcctcggatacggcgacaatacaaaagccgcactgatgaccagaggaatcgcggaacttaccagactgggagccgctctcgggggacagatcgagacatttaccggtctgaccggcatcggtgacctgatcgttacctgtacgagcgttcacagccggaacaggaaagccggactcctgatgggacagggatattctccgaaagaggctatggatgaagtcaagatggtcgtggaaggtgtctattccgccaaagcggctctcggactcgcaaagcggaataatgtcaatgttccgatcattgaggaagtaaacaaagtactctttgaggagaaagatccgaaagaggcagtggcagatctgctcttaagggagcgcaagaaagaacatacaaaccttaaatgggaagaagaataagaaaggacaaagctatggcagaattcgcggaaatgtcaaaggaagaattggaacaggcaaaggaagcagcagacagggattacgaggaactgaaggccaggaatttaagccttgatatgtcaaggggaaagcctgcgccgtcgcagattgatcacgccaacggcatgctgaaagaaatgacggactatcacacaaaggcaggcatggatgtgagaaattacggcgttttggacgggattcctgagatgaaggaacttttcagtgaactgctcgatattccggccggccagctgatcgtcggaggaaatgcaagccttaacttaatgtttgacgcagtgatgcgtttgtttgtgttcggaacgatgggagagaaaccgtggggccggcttgacaaggtgaagtttctctgcccaagtcccggctatgatcgtcattttaccatctgcgagactctgggcatcgaaatgatcccggttcctatgaccaaagaaggcccggatatggatatggtggaagaacttgtgggaagtgatacgtccatcaaaggtatctggtgcgttcccaagtattccaatccgcagggcatctgttacagcgatgaaacagtagaccgactggcttccatgaagactgccgcgaaagacttcaaaatattttgggacaatgcctacggtgtgcatccggtctttgaggatgtgaaagttaagaatatcatcgacgcatgtgaagaagccggtacaaagaatcgtccgtattatttcttctctacctcaaagatcaccttcccgggagccggtgtcagcctgatcgcttccagtgaagagaatataaatgaaatcaaaaagatcatgggtgtccagacgatcggatatgacaaagtcaaccagctgcgccacgtacagttctttcaaaatgcagagggactgagagcgcatatgcaggttttggctgagtgcatgaggccgaagtttgaaacggttctcaaatacctgaacaaagagcttgcaggaacagggctcgctgtatgggaggagccgaaaggcggatattttgtgtccgtggatgtatatccgggatgtgcaaaagaggttgtacgcctggcaaaagaggcgggagttgtactcaccggcgcaggagcgacttatccatacaagaaggacccgaaggacagcaatttaaggattgcgcctacataccctacagtggaagaactggaacaggcgatggaactgttctgtgtctgtgtaaagaaggcagcgctgcataaactggtcagagaatagaacataaggactccggagacgagcatttaagcttgttccccggagtctttcagtttgcggtagacagtgagcagcattgtgacatagcaggcggttcctccgatgaaattggagatgggctctgcgataaaaacaccgttgacaccgagaccgaacagcattggcaggcagacggtcaggggaagaacaatgacgaccttccggaagatagaaaagaagatagcctgtctggacctgttcagcgcgatataggtggactggcccgaaaactgcagggacatcatgaagattccaaagaaataaagctttaaggcggggacaccttttgctatgatctccggactgctgttgaaaatatggataaaaaagtgcggtgcaagaagcaggataccccatacaataaaggtgtagccgatgcaggcaagagtcataaaccgaatggctgccttgactctttcgtactgttcagctccgtaattatatcccagaaccggctgggcgccgttggtaataccggtaaccggcatcgtgatgacttcccggatcgaatttaaaatcgtcatgacggtcacatagagatctcctccatagacctgcagggttgcgttgcaggcgatctgtacgatactgtttgtgaccgacatcgtaaaaccggaaagaccgagggttacgatctgcctgaccagacggaactttaacctaaagttttcctttttcagttttagtattgtttttctgccggcgagaaagaggaggacccatacagaggaaacaaactgggaaatgacggttgcgagagccgctcccctgacacccagctgcaggataaagataaaaacaggatctaatataatatttaagacggcgccgattaaaactgtcagcatcccggttcttgcaaaaccctgagagtttatgaagctgttcataccaaggccgatcatcacaaaaacagatcccagaagatagatcgtgatgtagctgtctgcatagggaaatgtagcttcgctcgctccgaatgcataaataatcggttttttaaaaatgaggattacagccgtgagcagaaggcccaggagaatcagaaggaaaaaagaatttcccatgatctcctcggcctttttttgatttccttttccgcgttctatggaacaaagaggagcacctcccatgccgatcagattggcaaatgccatgatgatcgtaataatcggaaaggtaatgcccacacctcccagggcgagagcggcatcttgtcccattcttcctatatagatacggtcaacaatactgtaaagtacgttgatcagctgagccagagtcataggtacagccagatttatgatgttttttgtgacgcttccttttgtaaaatcattcttttccttttccataacaggattcagcctcatttcttcaaaatcttcgataaaaagtatagcatgttttccggataaatagaatcttgaattaaataacatttggatatatttatataaaatatttacctataaaaacaattgaaaaggaaatataaatcaccacacttgtatacagaaatgcataaatacaggcagaaaacaaaacattctttagttaaaactgtcgaacaaatgacatttggacatattctgcacacaaaatcggctagaaaaagtatgtccggatgttataatttagataacatcgatggaagaaaaagaaatgatcaggaggtaagaaaatggcattattttcaaaagggaaagaagtgtttggatgtccgatggacggtgaggtgagacctttgagtgaaacaccggacagggcattcgcagacggacttcttggagatggagtggttatttttccatcgggagataaagtgtttgcaccgtcggcagcaaaagtaaactttacatttccgacacgccatgcagtcgggctggagacaaagtctggatatgaatatctgatccatgtagggatcaacacgaatcagctgaaaggagagggatttcatatatatgtaaaaccgggagattatgtgaataaaggacagcttttgctggaatttgatcaaaaactattaaaagaaaagaatttatcagaagcaacccctatcgtatttgccaatgtagaaaacgacaacattgaagtgctgaaggcaggccgggttaaagccaatgaagatctgatggtcgtgaaaaaataggaggatgaatataatgaagctatcagcgcgtgaaaaatatagctatggaatcggtgccctgggaaaagatatgatctgcggagtcatatttacctatgcaatggtctattttacagatgtactgaaaatttcagcggcatttgtagggacactctttttctttgcaaagttctgggatgcggtaaatgatctcggaatgggaatggtcgttgacaatacgaaaacaagatggggaaattcaggccgtggctggctgttggaacattgatcaatgccgttgtttttgcctgtttatttacggactggggattatccggaaccgcactctatgtttttgctgccgttatgtatattttgtggggaatgacttataccattatggatatcccatactggtctatgctccccaatctgaccagtgacaaatcagagcgcgaccgggtggctgtagttcccaggatcttcgcatctgtgggaggatccctgatcgtcggaggatttgggcttcagatcatggactttttgggaaaaggtgatgcgcagaaaggattttcttatttcgcatacataattacggctgtatttattatcaccattgcaattatggtcacaaatgtaaaatcagcggatcatgtaagagcagtgaaggaagagaagacatcctttaagaaattgctgcatatcatttcaaaaaatgatcagcttcttgtagccattgcagtaatccttacatttaattttgcgatgcaggttatgacaggggtatctctatactacttcttatatgtggcaggcagcaaatcaatgttttcaatctttacgatgtttgcagggattgcagagatctccggcttgtttctgtttccatggatcgcgaaacatctgaacagaaaccaggtttatcttttggcaagcctgataccgacaattggactggggctgttattcgtcatcggatatctggcaccgacgaattttgtattgacagccatcgccggctatggtgttaaattcggttccgggcttcagcttgggattgtgacggttgtgctggcagatgttgtcgactatggtgaatataaattcggaacaagaaatgagtctgttaccttttctatccaaacactgctcgtaaagtttacttcggctatgggtgcgcttcttaccggatttgcactgaatgccacggggtatattccaaatgcagtacagacagcatcaacacagaacggtatccgttttgttatgatcggtgtcccgattgtttttgtagccctcagttttatgatctacaagacaaaatttaaacttcatggggcgtattacgacaaaatcatgaatgttctggcattgagaaaagagaaactggacgagcgtctggcaaacaattcataataattatagaaaagacggaggaatctatatgtcaattatttttcatgagagatctaaaacatttcatctatataatgataagatcagttatatttttaaaatcttaagaaacggtcagcttggtcagctttactgcggagcggcaatacgggacagagaagaatatgagcatttatttgaggcaaggcagcgtcccatggcgccgtgtacctatgaaggggatctgacgttttctatggagcatatcaagcaggaatatccggcttatggatcaggggatatgagatatccggcttttcagatcctgcagagcaatggaagcagaatcacagattttacatatatatcccataagatcatggaaggaaaaccagagcttccagggcttcccgcaacctatacagaggatccgaaagaggcacagacgctggagattcttcttcgggatgaattgatccaggtggatctgctgttatcgtattccatatttgcacattatggagctgttgcgcgcagtgtacggtttgtgaatcggggaacagagtctgtgatcctggatcaggcaatgagtctgtgtctggatcttccggattcagactacgaaatgatcgaactgaccggagcgtggtccagagagaggcatataaaggagcgcagactgtgccatggcatccagtccgtgtacagtatgagaggctgcagttctaataattataatccgtttattgcactgaaacgggaaaacaccacagaacatgacggagaagtttacggtttttcctttgtgtacagcggaaactttcttgcgcaggtggaagtggatacttatgatgtctcaagggtcaccatgggaatcaaccctaacacgtttacgtgggaattaaaaccgggagagaactttcagacaccggaagcggtgatggtctacagcagtgagggcttaaacggtatgagccagacttaccatgagctgtatcagaaacggctggccagaggagaatggagggatcaagtccgtccgattcttgtgaataactgggaagccacatactttgattttgatgaagataaaattcttctaatcgcagatacggcgaaacgtctcggcatcgaattatttgtcctggatgacggctggttcggcagaagagatgacgatacaagttctctgggagactggtacccggaccttaacaaacttccggaaggaatcaagggcattgcggaaaaaattgaaaagaaaggtttgaaattcggactttggtttgaaccggagatggtcaacaaagacagtgacctgtatcgggctcatccggactggatgcttgcggctccgggcagaaacagctgtcacggaagaaatcagtttgtcctggatttttccagaaaagaagtggtagattatatataccggctcatggaaaaagttttgctggatgctcctgtgtcctatataaaatgggatatgaaccgctgtatgtcagaggtgtattcagcaggatgcggtgcatcggatcaagggaaagttacacataaatatatccttggggtatatgatctttatgaacggctgacaaagaagtttccgcatatcctgtttgaatcctgcgccagcggaggtgccagatttgatcccggaatgatgtattatgcgccccagtgctggaccagtgatgatacggatgcaatagaaagaattaaaatccaatacggcaccagtatggtttatccggtcagcagtatgggagctcacgtatcagcggtgccgaatcatcaggtgctgaggaatactccgattgagacgcgggctaatgttgcctgtttcgggacttttggatatgaacttgatttgaatcagttgtcagcagaggaacaggaaaaaataaaagaacaggtggaatttatgaagacataccgggaggtccttcagtttggaaccttctaccgccttcagagcccttttaaacacaatacaagtgcatggatgtcggtctcacaagacagacggacggcggtcgtcggatacttccgcacgctggaaccggtgaattcaggatatacaagactgaagctccgggggctcgatgaaaatttatgctatcatgtgacaatcaatgaaaccagccactacggcgatgaactaatgaaagccggactggtgacttcggatgcctccagcggtgaaaaccgtgagacatataacggagccaacggagattaccagtctcgcctatatatcttaactgcggaggacgaattgcgagcgccttccgtacgttcctaatgaaggaaagactcctgctgtttacagtatggagcctttcctttttatctattcagaatgcttttggttttctgctttgtgagggtcgaaatcccgtataatattcggaacattccggttttctttgcggtaggccgtgggacttaaaccggtaatttttttaaatgccttggaaaaggcaagctgattggcataaccgcaggagtatgagatattcttaaccggaagatccgtatctgaaagaagttctgtggctttggtaacgcggaatcttaagaggaactgctggggtgacatatgaaggttttcctggaacatgctgcagagataactccggtttaaagaaacataatcagcaatgtccctgacggtaatgacattctggtaatttttctgtataaattcaatggccttgctgatatgtatgttttcacttgtaaaatcagacttgtatttaatatcagcggaccggctgaaggaggcaaagatcagaaagagtatgccctgaatataaatctcattgctgtagcttaaggtattatgtctgaggatatcttcaatataagatacaagaagttctttctcctcacagtgacagatcagatgttcactgtccagaccgcagcgctgaagatagtcattgacttgatttccggaaaaaccgacccagagataggtccagggatcttgttcgtctgcctggtaaaaggttacttcatccgggaggatcaagaaagcgtctcccggctcaatggtgtactgtttgtccccggcatagtaatatccttttccgctgacacagtagtgaagcaggtggtggctccggacagcaggaccgaaggaataaagaggtgtgcactcctgtatgccgcagaaaaggagataaaagtcagaaaacatctggttcttgatttccaaaaatgaatacatagtctctcctttccctgttttttacttttattttataatacaaagcggtaaaacacaaccgggaaacggcagaaaacactttgtgtttctatattgattatggtagaataaataaaatattaaaaacactatgaaaacgaggagtgattccatgaaatttacaaagatgcatggctgcggcaatgattatgtatacgtgaactgttttgaagaaacgatagaaaatcccaatgagacggcaaagtttgtcagtgaccgccattttggaatcgggtcagacggtatgatctgtattcatccttctgacaaagcggatttccggatggccatgtacaacagtgacggtacagagggagccatgtgcggaaacggagtccgctgtatcgcaaagtatgtatacgactatggattaacggacaaaacaacgatcaccatcgagaccaaaggcgggatcaaagaactggaccttacagtggaagacggaaaggtcacatgggtcaatgtagacatggaggcccctgtgctggaggccgataaaataccggtgatttatgatgaggagaaaaaagtcatcgacaagcctgtcatcgtagacggcagagagtacaggatcacctgtgtatctatgggaaatccccatggagtcgtgtttgtagactctgtggatgatcttgatattgaaaagctcgggccgatgtttgaacatcacccgatgtttccggacagagtcaacacagaatttatccaggtggtcgacgaccatacgatcaggatgcgtgtttgggagcgcggagcaggggagactctagcctgcggaaccggtgcatgtgcaagtgcctatgcaagctatctgaatcagaagaccggcaataaagtcctggtccaccttctgggaggagatcttcagattgaatatgacgaagagaaacataccatcttcatgaaaggaccggccacaaaagtatttgacggggagattgacctttaaaaagttttggcttaggaggaatctatgaaattatcaaaattattagaacgctcagaatacactctcgtacagggcacggaagatacagagatttcgactctcgtatatgactcaagaaaagtggaggagaacagtgtttttgtctgcatttccggggcagcctttgacggacataagtttattgggcaggtaatcgaaaagggtgccaaagttatcgttgtacaacaggatgtggaagctccgaagggcgtaacggtgatccgttttgacgacacgagaaaggcgcttgcagagatgtccgcagcttacttcggatatccggcagaggaactgacgaccattgggataaccggaaccaaaggcaagacaacgatcacttatatgatccagtcggtgcttgagcacgcggggcagaagaccgggctgatcggaaccattgagactgtcatcggggatgaaagaatcccttcggtcaatacgacgccggaatcttacgtgattcaggaatctttccggaagatggcggatgcgggatgcaaaaatgtcgtcatggaagtttcttcacagggactgatgctccacagggtgagcggctttacctttgactatggtatttttacgaatctggccgaagaccatatcggagaaaatgaacacaaggatatggatgactatatccgctgcaaatctcttttgtttcagcagtgcaggcagggcattgtaaacggggatgatgactatgtagaaagaatcatcaaggggcatacatgttctttagagacctttggcatgaagccgggcagcgatgtgtatgccgaacatatagagcgtatccaggaacccggttatcttggcgtttcttacgatttaaaaggaaaagaagagtataacattcatgtggacattccaggagactttacggtctataattcgctggcagccatttcattgtgccgccatatgggaattcaaaagaaagatgttctggacgcactgaatacgattcaggtaaaaggccgtttagagatcataaaaacaccgggcgaatacaccctgatgattgattacgcccacaatgccatgagtctcgaaagcctgctcacgacgatacggaagtatgatccgaaaaagatctactgtctgttcggctgcggaggcaacagggccaaagccagacggtatgagatgggcgaggtatcttcaaaacttgcggatcttacggtggtgacatcagacaatccgagaaatgaagaaccgatggacattatcaatgatattctggtgggagtccataagggaccgggagaatatgtcacgatccctgacaggaaagaagccatccgctactgcatggaacatgcgggaaagggcgatatcgtcattctggcaggcaaaggccatgaagattaccaggagatcagaggagtgaaacatcatatggatgaaagagacttgatccgggagatcatcgcagaatccatttaaattcagaacacaaaaaccgaaagcatcacgcatgtttccgggaggagattaggaggaactatggacagcagaattaaaggaacaacaagattattgggactgatcgggtcaccggtgggacattcaggatcaccggctatgcacaattatggatttcaggcgctcgggattgacgcggcttacctggcttttgatatcaaagaagaccaggtaaaagatgcaatcagcgcagtgcgcacactgaatatgcaggggctcaatgtgaccatgccgtgcaagaccgaggcagcaaaatatatggatgaattgtctccggcagccaggctgatcggtgcggtaaacactgtggtaaacagagacggaaaactttacggacatatcacagacggtgaaggatttgtggcaaatcttaaggatcatggggtttcaatcgggaaaaaagatattgtgatctttggggccggaggtgctgcgacagcgattttggtacagtgtgctctggatggcgcaaattccgtcacggtcattaaccccagggatgatttcttcggacgggcggaagagatgcataaaaagctccgggaagaaactccggactgtgacatcactttgatcgatctggctgacgaagctgctgtcaaagaagcggtatcaaaaaccgatatcctcatcaacggaactcttcttgggatgaaaccaaaagaagacacttccgtgatccgggatacgagcctgttccgcaaagatatggttgttgcagatgtggtctataatccgaaagagacaaagctgttaagagaggctaaagcagcgggctgcaggactgttcagggagacggaatgctcttatggcagggagtggctgcatttaaactgttcaccggacaggatatgccggtaaaagaaataaaggaaaagttcttttcttaaaacagaatacataatcaaccagtgataataagagaaaaaggattgcccgggcagtccttttttctttcttacagtcatatcctggcagaatactgcatatactttaacagtctatcgtaggaggatattatggattactttaatgtatataaggatattatggccaggaccgacggagagatctacatcggcgtggtaggtccggttaggaccggaaagagtacgtttatcaagcggtttatgaacctgatggttcttccgaacatggaaaatgagaacgaaagaagccgtgccaacgacgagctgcctcagtcatccagcggaaaaaccatcatgacgacggaacccaagtttgtgccgaatgaagcggtggagatcaacgtggatgacggcatcagcatgaaagtccgcctcatcgactgtgtgggttacatggtaaacggagctgtgggccatattgagggagaagaagaacggctggtgaagacaccgtggtttgattatgagattccatttacaaaagcggccagcatcgggacaaaaaaagtcatcacggaacattccaccatcgggatcgtagtgactacagacggttccttcggcgacatagaggcggccaattatcaggagccggaggaagagacgatcaaacagctcaaagcattacataaaccatttgtggtacttttaaatacgagccgtccatattctgaagaaactgtgaaccttgccaaagaaaaggaagcaaaatacggggcaaaagtgctcccgatgaactgtgaacagcttaagaaggatgatatttattatatactcaagagtgtactgatggaattcccaatttcttcgattggcttttttgtaccgaaatgggtggaggtacttccgcacgatcacaagatcaaacaggaaatcatggagactgcccggaagatgctcatagagaaggataccatgaaagacatctatgaggaggaagattacgaaaatcaatacataaaacagtggaaactggattctgtcgctatggataccggagtgatccgtatcgcagtggatatggatgattcctattattatgaatttttaagtgatacgattggacttccgatcaagaatgaatacgaattcatctcgatcatgagagatcttgcaagacagaaaaaggaatacgaagaagtggccgatgccctgaacgcagtgaaacagaggggatacggtgttgtgaccccgacaaagggagatattgtcctggaagaacctaagatcgtgaagcatgggaacaaatacggggtgaagatcaaggccagtgctccgtccattcatatgatacgggccaatatttccacggagatcgcaccgatcgtcggagaagagtatcaggccaaggatctgatggagtactttgacaagggaaagagtgatcctcaggaaagtatatgggatatcaatatttttggaaaaacactggagcagcttgtcggagaaggcatgcagtcaaaagcgcagaagatgacagaagaaagccagcagaaactgcaggatactatggaaaagatcgtcaatgagagcaacggcggactggtctgcatcatcatctgacaatagctgggtggcattgacaaattacgaaaaaaagaatatactttggtaaacaaaatattaggaaagcgcaggataaatgataagatgtcgattagaatattaggtacaggaagttatcttccggagacgattgttacaaatgatgatttagcaaaagtgatggataccagcgatgagtggattgccagcagaaccggtatccgggcacgtcatatttctgtggacgatacaacatccggcatggcagtgaaagctgcaaaagaagccctgaaggaaagcggagtcgctccggaggagctggactgtatctttttagcgacattgtccggtgaccgggccactcccaacggggcctgtgacgttcaaaaagccatcggagcaaggaatgcggtctgtatggacttaaatgcggcgtgttccgggtttgtctatgctctgaccactgcggtcgcctatgcaaaagcagcattggcaaaaaagatgctcgtcatcggtgtggaaaccttatcaaaggtcgtggattggagcgaccgcagttcctgtgtcctgttcggagacggggcagggtgtgcagtggtggaagcggatgattccagagaagtatttatcgattacggatctaacggggaactcggggaagcgctgacctgcggggagagaaaattaaataacttattggtagagaaccatgagcctttggaacaagtctttatggacggacaggaagtttaccggtttgcggtaaagacggttcccaggacgattgaaaatgtattggagaaagcaggagtttcaaaagatgagatcaaatattacgtcctgcatcaggccaacaaacggatcatcgattcggctgcaaaacgtctgaagcttgacatagaaaagtttccgatgaacctggaccggtgcagcaatacttcttctgcaagtgtcccgatcttattggacgagatcaataaaaagggtttgcttgagagaggagataagattgtcatgtgcggatttggaggaggtctgacctggggaacgatttatttagaatggtaagaaacggccggagacgattccggtgtcacctgagaaaaaagtagggctttcctgctttttttgtttatttcacaggaaagtttcaggacttccctgtggaatgaaaacgctccgccgattgagcacagatgcgtgaggatgaacgtgcttcaaatgttaaagtatgctataatataagaatatagattaaaggaggtgttggcaatggaattacagatgtggagagagatcctttgcccttacgacttagctgtggaagaattaaagctgaagttcgtacacatcatgaacgagtacaggaccgcaggccgctattcaccgatcgaacaggtggatgggagagtcaagagtatttccagcattcttgacaagatgcagaggaaaaagatcaatatcaatgaaatcgagaccgatctggaggatattgcgggcatcagagtcatttgtcagtttgtggaagatatcgaccgtgttgtggagattattgaacagcggtctgacatggagattaagacaaaaaaagattatataacaaaagcaaaggacagcggataccggagttttcatgtcatcatctattacgatgtggatacgatctacggaaaaaaacgaatccaggcggagatacagatccgcacactggccatgaatttctgggcaacagtggagcactcccttcagtacaaatacaaggaaaatatcccggagcatatcacggaaaagctcatgaatgcggcggatgccatcgtggtccttgacaaggagatgtccattgtcagagatgagatcatggatgcacagaattctttcaggaagaaggcaaatatcgtttctgagatcttgtcaacgatgcagaatttatataaagttgccaacaaacaggaagtcatcaagatacaggatgagttttacaaaatatatgagacaggagatatggagcagctgatccatttcaataagcagctggacatcattgcggaaggctaccgcgcacagagcctgtcataggagaagttatggaattaccacaattattcgttgagaagatgaaatcccttctgggagaagaatacagcgattatgaggcatgtttaaagcggccgaagcagaatggcatccgggtcaatacatcaaagatatgggtggaagaatttcaaaagatcgcaccatttgagaccgagccggtgccgtggacgaaaaatggtttttttgtcggaccaaaagagaagcctgcgaagcatcccttttatcatgcgggtctgtactatattcaggaaccgagcgccatggcacccgcggcatttcttccggtagagcccggggacaaggtactggatctctgtgcggcgcccggaggcaagtccacagaactcggggcaaagcttcggggagagggaattctggtgtccaatgacatcagcattacaaggacaaaagcccttttgaaaaatttagagatgttcggcatcagcaacagcgtgatcgtaagcgaggaacctaaaaatcttgttccggtcttttatgagtatttcgataaagtgcttgtggacgcgccctgttcgggggaaggaatgttccgcaaaggcagcagcgagattaaaaactgggccgaatacggcattgaaccttatgtaaaaatccagagggaaatcatccttgacgcggtaaagatgctcaagcccggaggatatcttttatattctacctgtaccttctctccggaagaggacgagcagctgattgagtacctgctggaacaggagcccgggctgtccctggccgatctgccggactgtgaagggtttgacagaggacacgccgaatggacggtgtcagggcttcaggatgtaaagaaatgcatcaggctttggccccacagaatcaaaggagaaggccactttctggctcttttgaaaaaggacggctctccggcttcggacaggaaggagtcaggaaatgcccgtgcggtgatctctgaggaggcggaagcctttttgtccgggtgcaggatggaccttgacagagacaggatcaaagaacataaggggagactgatccttatgccgaaagaactgcctgaccttggcaggctccgggttttaagacacggactgcttttgggagagatgaagaagaaacggtttgagccaagccaggttctggctatggcgctttccggcagcggatatgtgagaaccctggatctaagcctttcagatgacaggctcatgaaatatctgaaatgtgaaacgatacttgcagacgaaaaagaagacggtgtgtatctgatcactgtctgcggataccctctcggatgggggaaactttcaaagggacggatgaaaaataaatatgcgccgtcatggagatggatgtgatgaagacactgcgtttggacaagtttttatgcgatgtcctgggatgcaccaggagcgaggccaggaaaatgatccgccagggcagagtcctggcaggagacgagatcattaagaaaccggaatataaagtaaacccggaagaagatgagattacagcggacgggcagagactgaacttccgggaatatgagtatctgatgatgaacaagccaaagggcgtggtgacggcaacaaaagatggaagagataaaacggtcatggatctgctcactggaagacacaggaaggggctgttcccggcaggcaggctggacaaggacaccgaaggcctgctgctcatcacaaatgacggagaactggctcaccgtctgctgtctccgaagcatcatgtcacgaaatgctactctgtcactgtaacaggggaaattggcagagagcagcaggagatttttgagtcaggcatggatatcggagatgacaagcctttgaagccggcgaaacttgtcatactgacttcaggagaagtatcgcaggcagaggtgtttatcacagaggggagattccatcagatcaaacggatgtttgaggcggtaggcagcaaagttttagaactgaaaagactttccatgggaagccttgttctggacccggaacttctcccgggacaggtcagagagcttacggaagaagaaatcaaatgtttaaaggagaactaatgctaaaagataaacgagcagttatttttgacctggacggaacccttgtggattccatgtggatctggcgggagatcgacgaacggtttttgggacagtatggcctgcaggtaccggatgggctgaacgatttcctggaaggcttcagttttaatgagacggcggagtattttaaaaacaattttccgctgccgctctccgtacaggagatcaaggacacatggaaccgtatggcctgtgagatgtatatgaatgagatccctctcaaggagggggcaaaggagtttctggatatcctgaaggagaaaaagcttccgcttggaatcgctacaagcaattccagggaactgacaaaggcatgtctcgatgcccatgggatcggggaatattttcagtatatctgtacctccaatgaagtgccgaaagggaaaccggcgccggatgtgtatctgaagaccgcggaggagctctctgtttctccggaacatattttagtgtttgaagatattccatacggcatcatggccggaaacagcgcgaatatgacgacctgtgccgtccgggattcctactcccaggcggtgacggaaaagaagaaggaattggcggactattacattgacacttactttgatatcataaacggaacctatcaatcagtttaagcgatacgagaggtgataacatgaagaaagtagcgattattacaggtgcttcctcagggctgggaaggcagtttgtcattcagacggcaaagagtcatggatttttagacgagatctgggtggtggcgcgaagggcagaccgcttatttgaacttggggtgctggtttccaacatcgtgatccggccgattcctctggatcttgcgaaaaaggacagcgccgaacggatcagaaatatcctggcaaaagaaaagccgaaagtttatgtgctggtgaactgttccgggctcggactggccgggaagtttgaccggcaggaggaagagatgctggatcagatggtgaaagtgaactgtctcgctctcacgaggatcaccagagccgtgctgccgtatatgccaagaaaggcacgtatcgtacaagtggcatcttctgcggcatttgtacctcagccgggatttgcagtctatgcggcgacaaagtcctatgtactgaatctgagcctggcattgagacaggaactgaaaaagagaggaattattgtgacggctgtctgtccgggaccggtaaagaccgaattctttgatacggcctatcaaaaaaaagaaatgaaactatataaaaagcttgcaatgtcaaagccggaaaaagtagtaaaaaaggctctgagggatgtaaaaagaggcagggcggtctctgtctacgggctttccatgaaggcggtgagagtcctctgcaagctgctgccgagcggtctgatcgtcaggctgataggctagaagggaacctgtatgaaagaaatcagaatctcagccagggaagaagaacagcggctggataaactgctagcaaaatatctgaacaaggctccgaaaagttttctatataaaatgctccggaaaaagaatattaaactgaacggaaaaaaagcatcaggaaatgaaaagctgaaatccggcgatgtggtgtgtatttatatggcggacgcaaccattgcctccttccggaaagaaccgagggcggagaggagaaaggcggatctttctgtaatttatcaggactccaatgtgctcatcattaataagccttacgggatgctgtcacagaaagcaaagccgtcggatgtgtcagtgaatgagctgatcgtcccctattgtctggaacacggcattttaaaggaatctgacctggaattaatccgtccgtctgtctgcaaccgcttagacaggaatacgacggggctgctgatcgcgggaatctctctggaagggcttcagacgatggcggaagtgctgagagaccgttttgtgaaaaaatattactattgtgttgtaaagggcacggtgaacgaaaaagcaagaatttccggatatatatataaggactgcagagaaaacaaggtttctttttcggagcagaagctcggcgaaggcagcagaatcgagacggcctatgagccgatggcagccgggcacggctttacgctcctgagggtggaactgattaccggaaagacgcatcagatccgggcccatttggccgggatgggattccctctggcaggggataccaagtacggagacagggatgtcaatctgtggatgaagcagaagttcggcgtaaagcaccagctgctgcactgcggctgtcttaagtttcccgaaaagatggaaaggtgcaggaaactgtccggcaggaccgttgccgcagagcctccggaaatatttttgaggacagcaaatgaattgtttgggagagtcgtatgggaacctggaatttaaaaggactgaggggatcggttctggaggaattgatcaaccacacaaatgaaaaatataaggaacaggggctggcactgatccagaagatccccacctccataaagccggtccggtttgacaagaccacccggcagatcactttagcatattttgaccagaaaagtacggtggactatgtgggggctgtccagggatatcccgtctgttttgacgcaaaagagtgcggaaacgacgtatttcccgtacataatatccatgaacaccaaatagaatttatggagaggtttgaaaaacaggggggcataagctttctgctgatttattttacccacaggcaggcctgttatttcatgtcttttgaggagacgatgaaatactggaacaggcagttaaacggcggtccgaagcattttaaatttgaggaactggatgcaggattctttgttcccatgaaaaaaggtatgatcctgcattatttagagtgcctgaataaactattggccgggaggcgttgacttagcctgctgtttttcgtataataaaacattgaaacagccgttacgtccggcaagtgaatacacagaaagaagatagaccaatgattagaagtatgacaggatttgggcgcagcgtcgtatccaatgacaacaatcagacgatcaccgttgaggtgaaatcagtcaatcacagatactgtgatatctcattaaagataccgaaaaagtttactatgtttgaggcggatgtccggaacctgtttaaacagtatgcgaacaggggaaagatcgatctgtccatatcatacgaagacttgtccgagaccagcgtaggtctccactataaccgagcgatggcaaaagagtacatggatgcctttcatcagatggaagaagagtttggaattccggtgtcggtcacggcagaacgcctggctcagtttcctgaggtgctctctctcacagaagagacttttgacgagagccggtggtggagcctgatcgaagcagctgtcagggaagccggcgggaaattcgtcgagtccagaacagtggaagggaaaagacttttggaggatatggaaggaaagctagcccggatggaagaagacattgagtttattgccgagcgttctccgtctattattcaggaataccgcacgaaactggaagataaggtaaaagaatttctaaataacgccggaatcgacgaaaacaggattgcggcagaggtaaccttatacgcagacaaaatatctgtggatgaagagatcgtccgctttaagagccatatcaaggcgatgcaggaagaactctatgagaaagaaagcgttggaagaaaactggatttccttgcccaggaaatgaaccgggaggccaacacgatcctgtccaagtccagtgacgtggaactttccaaccacgccattgagctgaagactaacgtggaaaaggtcagggaacaggttcagaatatcgagtagggaggataaaacgatgaaaaaaggtgcgttggtcatcttatccggcttttccggcgttggaaaaggtacagtcgcaaagcgcctggtggagaaatacggatacagtctgtcggtttccgcaacgaccaggcagccccgggaaggggaggtggacggaagagactattttttcaagacggaagaagagttccgaaacctgattgactacaacggatttatagaatatgctagatatgttgaaaatttttacggcacgccgcggaagttcgtggaagatgagctcaatgcggggcacaatgtcattctggagattgaagtacagggggcgtttgccattagggaacagtatgaagatgctcttttgatcttcatcacggctcccagtgccagggagatcaaaaaccgcctgatcggaaggggaaccgagtctgaggaagtcatagcgaagcggctttcaagggcggtggaagagtccgaggacatgtgtcagtatgattatattatcgtcaatgacgatctggaagtgtgcgtcggccaggtgcatgcggtggtcactgcacagtcctgtgagcgcagacacaacatggatctggtaaaagaaacaatggaaggattaaaaaccttataggaggaatcatatttatgctacacccatcatattcagaattaatgcaggtcatcaacggagatgacgaagacaagaatatcatcaccagccgctactcacttgtcattgccagtgccaagagagcgagacagctgatcggtggagatatgccccttacggaagacgcagacgaacagaagcctctttccacggcggttgaggagatacggagtaataaagtaaagattcttcaggatggagaagacgaagaatagagaaagcacgaagggtgaataggattttttctagtcacccttttaaaatatcatcttgaaaggaacagaaatggatcttatattaatcttaaaaaccgttattttaggaattgtggagggcattacggagtggcttcccatcagcagcaccggtcacctgattttagtagatgagttcataaacttaaatgtctcggcagcatttaaagagatgtttgacgtggtgatccagctgggcgccatcatggcagtggtcgtgctctattttcacaagctgaacccgctctcgccaaaaaagaaccggaagcagaaacatgagactatggtactctggtacaaagtaatctttgcggtccttccggcagccgtcatcggcatactgtttgacgatgccattcatgacagattttttaatccggtggtagttgcggctaccctgatcatctacggtgtcttatttatcgtcattgaaaatcataacgagagaagccggagaagagggatggattctctctcgggccttacataccggatggcctttatcataggagtgtttcaggtattgtctctgattccgggtacgtcccgttccggagctaccattgtgggcggaatcctgatcggatgttccaggaccgtgtcggcagaattttcgtttttcctcggaataccggtcatgttcggagccagtcttttaaaaatcttaaaattcggtctttcctttaccggcacagagcttgtggtgctggccatagggatgatcgtttcgttccttgtatccattgtttcgattaaatttttgatgggatacgtaaaacggcatgattttaaggcgtttggagtgtacaggatcatacttggtatcctggtcatcggatattttatgtttttaaaataggagaattacatggagaaagaattatttttaaaagggatgcaggagcttttagaggtcgcaaaggccgggggcgacaagatccggaaggaagatattttatcgtatttcggaggaatgaacattacagatgagatcgagaccatgctctgcgactattttgtggaagctggagtgcaggtggaggggtatgaaaaaagcccgaaaaagaatacgcagaaagaagatacagatccgggagtgatccggttttatgaggaggaacttgcagagctgggaggctctgatcccgaaaaagtacgagaattcattgtccggctggcagacggggaagacgtccaaaatgaactgatcgagagtatgctcgccgatgtggcgctggctgccaagaattacacggggcacggtgttttgctcggagatctgatccaggagggcaatatgggccttatagaagctgtatttgaacttggagacaaagagccggaggaagccgagatatttttacgggaagcagcggagtcggcaatgaagaaggccgtttccgagcagatgaatacggactcggtgggagaacagatggcaaggcaggccaaccgtctggacgaggcagccagatttctggcagaaaaccttggaagagaggcaactgccaaagagcttgcggatcaccttaagatgacagaagaagaagtaaaggagatcatgaagatgtcgcttgatgcgatctctgtcgttgagacagacattacccggaaataggccggaatttccggccgcccatatgcaggaagaggtggggcaatgaacatcagagaaaagcaggaacagacagagcttaagctgctgagtccatatgcgacgcagagcagccgttcaaaggggagagaaaagcctgaagtggagtgcgaacttcggacctgtttccagagggacagggaccggatcgtccactgcaaggcttttcggcgtttaaaggacaaaacgcaggtgtttttgtctccgaaaggggaccactaccggacgagacttacgcacaccctggaggtggcgcagaatgccaggaccatagccagggcgctgaacttaaatgaactgctgacggaagctattgccctggggcatgacctgggacacacgccgttcggccatgcgggggagaggacgctgaacgaattaaatcccgaaggcttccgccacaatcttcagagcgtcagggtggtagagtgtctggaaaaggacggaagggggctgaacctcacatgggaagtccgggagggaatgaaaaatcattccacccacagcatttcctccactctggaaggaaagatcgtgcgtctggccgacaagaccgcctacatcaaccacgatatcgacgattctatacgggcaggagtcatgagggaatcagacattccggctgaatatacggatgtgctcggacatacggtgagggagagaatcaacacgatcatccgggatattgtaaagcacagcgagaaccggagtgatatcctgatgtccgaggaagtgcacaaggccatgtttgggctcaggagatttatgtttgaccatgtgtacttcaatcctcagacgaaaaaagaagaaagaaaagtgcaccacatcattgaaccgctgtttgaatattatgtccgccacaccgacctgcttcctgcttactctaaagagagaatcggggtgaccgagtccaaagaacaggctgcctgtgactatattgcgggaatgacggaccattttgccatcgagacatacaaagaaatcttcattccgaagttctggctggaaaagtgagaaaaataaaaaggaatgaatcagtttatgtagaataatatatatagaggacatttatcacacagataggaggacaggctgttgttatacggagatgacattattgaagaggtcagaagccgcaatgacatcgtggatttgatttcttcctatgtaccgctcaagcggaagggcagttcttatttcggactctgtcctttccataatgaaaaatcaccgtcgttttctgtcagcagggacaagcagatgtattactgtttcggatgcggggccggcggcaatgtctttacttttattatggaatatgagaactttacatttccggaagccgtgcggtatctggcagagcgggccgggatggaacttccggaacaggaactcagcgcagaagcaaagcagcaggcagacgccaaggtaaaattaaaagagatgaataagatggcagccaattatttttatatcctccttcacagcaaaagaggggaaaaaggacttgcatatcttacaagacgcgggattaccgaggagacgatcaaaaagttcggccttggatacgcagatatctatcaggatgacctctatcggtttttaaagagcaagggcttttccgacgaagaactgaaggattccgcactggtcaccattgatgaggccaggggaggcagtgataagttctggaacagggtcatgtttccgattcaggatgccaacagccgtgttataggattcgggggacgggtcatgggagacggaagccctaagtatttaaattccagggagacgaagctgtttgacaagagcaggaatctttacgggctgaattttgcccggagttccagagagaaatttatcattttatgtgaaggatatatggatgtcatttccatgcatcaggccggattcaccaatgcggtggcggctctgggaacggcgtttactgaagggcacgggatgcttctcaaacgttatacgaacgaagtgatactttccttcgacagcgacgaggccggtcagagggcgattttaagggcgattcccatcctcaaaggtgcaggtctcacggtcagagtccttaacctgactccgtacaaagatccggatgaatttataaaagaactgggaagcgaagaacttagaaaccgtatacagaaagccaggagcagcttcatgttccaggtatcggtggcggcaggaaagtacaatcaggatgacccggaggaaaaaaccaagttccagcacgaggcggcaaaactcttgtccggtataagggaacctctggagaggaataactactgtgaagccgtatccagggaattttttatgggcgtaaaggaactgaaagatctggtggagtattacggcaccagcggatatgttcaggagaaaccaaaggaacaggaacgaagaccggcggaagttaaaaaagaagaaaaaaggcaggagcctcagaaactgctgctcacgtggctggtcaatgagccggttctttttcagaagcttgccgggatcatcggaccggacgattttatcgaaccgatctatcacggcgctgccatgctgctctttgaagaatacgagagggacggcaaagtgacgccggctaagatactgaatcagtatacggacatggaagaccagaagaaaattgcggagctgttcaacacgacgctgaaattaaagcctctgcccgaggacaatgacaaggctttgaccgatattgtccggaaagtaaaggaagacagcattgaacacaagatgaatgaatccaacgacatcatgaaatggcaggagctgatccaggagaaaggcagactggcaaagctgcatatttcgatttaggttggttaaaataggtatgagaggaaggaaattaatggacgaaacaatgttacaattcagcgagaagctggcaggtttagtagaactggggaagaaaaataaaaattttctggagtatgcccagatcgagacatattttaaagattttaagctgacgtcggatatgatggaggcaatttttgattacctggaacaaaacggagtcgatgtgcttacgattcctgagggagaggacgacgaagatctggagatcaaggaagagatcgaagaagaagcggacctgacgatcccggacggagtcagcatcgaggacccggtgcgcatgtatttaaaggaaatcggaaaggtacctctgctgagtgcggatgaggagatccgtctggcccagaggatggaggaaggcgacgaggaagccaagaaaaaacttgcggaagccaacctgcgtctcgtagtcagcatcgccaagcgctatgtgggacgggggatgctgtttctggatctgatccaggagggaaatctgggtcttattaaggcagtagaaaaattcgattacaggaagggttataagttcagtacgtatgccacatggtggatccgccaggccatcaccagggccattgccgaccaggcaaggacaatccgtatccctgtccatatggtggagacgatcaacaagctgatccgtgtatccagacagctcctgcaggaactcggaagagagccgcttccggaagagatcgccgaggagatggatattccggtggaccgtgtgcgggagattttaaaaatttcccaggaaccggtatctttagagacaccgatcggagaggaagaagacagccacctcggagactttatccaggatgacaatgtgccggtgccggcggatgcggcggcatttacgctgctgaaagaacagctgagcgaagtgctcggaacattgacggagagagagcagaaggtgttaaggctgcgcttcggactggatgacagccgtgcaaggacattggaagaggtaggaaaagagttcaacgtcaccagggagagaatccgccagatcgaggccaaggccttgagaaagctgagacatccgagccgcagcagaaaattaaaagactatttagattgatcgggtgagatatggaactgtcatcacggttaaaaacaattgcttcttttgtgtccgaagggatgtgtgtcgccgatataggaacagatcatggatacatacccatttatctgacctccgaagggatgacggacaaagcatatgccatggatgtcaatcggggaccgcttgaaagggccggggagaacataagaaaagaaggtcttgacggcaggatcgagtgcatcctttcggacggcatggaaaaacttccgatagatgcggacagtgtggtgatcgccggaatgggcggagacctgatggaacagatcttaatggggggagaggacaggctttttcggctctcagagctggtcctctcaccacagtcccactgggagaaggtcaggagattcctgcacagccatggatttgccatcgaaaaagaagcactgataaaagaagacgggaaatattatattgtcataaaagctgtcaggggccgggaatcttaccgtgagtcgtggcagtattcttacggtacttatcttacgggattaaaaaatcctctgatgaaggagtatctgaaaaaagagctgaaggacaaacagaagatccttgactcttttgagggaaaggattcagaacatctaaggcgcagggcaggagaactgtcctgtatcctcagagagataaaggaggcactgaagaactatgaaatgcagtgaactgacggagatattagaagattatgtgccggcacgttatgccatggagtgggataatgtgggacttcttacagggagaagagacaggaagatccataagatcatggtcgcattggatgcggacaacggggtggtggaagaagcagtcagacaaaaggtggaatttctgctgactcaccaccctcttattttttctccgcaaaagagtatcaccgatgagtcgggcacacaaaaaaagcttctgaagctgatagaaaacggcattaattgttttgccatgcatacgaatttcgacgtggtgcatatgggaagaatcgtctgtgaggcgctgggacttaagagtctggctccggcagaaacgacgtgtacagaagacgggattccgaaagggatcggtacagtatcagaacttgagtgttctatgacagcaggggattttgcagaactggtaaaaaatacgtttgatattgaacatgtcctgctttttggagatgaaagaaaagaaatccataaggttgctgttgttccggggtccggaagacatatggaacagcaggcggccgagacgggagcagacttatttttaaccggagatatcggacatcatgaagggctggacgccatggaactggggcttacggtcatcgacgcaggccatcacggactggaaaagatcttcgtagattttatgggtaaatttctcgaacaaaaagtgccggagtgtgagatcatcctgagtcatacaaaatgtccgtttgacgtaaaatagagcagagaggagttgatggctgaatatgctgcatgtatcagtagaaggagcaaagatcagtgtaaaagagggcacggccctggaggaacttgcgaaaaggtttcagaggccgggcgcccctgttattttgctcgcctatacgggagagaagctgagagagcttcaccatacgattgatgaagactgtgatattcggtttgtgacgaatgaggagcagactggatatatgacttataagaggacggttaatttcgtgtttttaaaagcctgtgaggaagtgctgggagaagggtgcaccaaccgaattacgatgaattactccatcggcaacagtaccttctgtgaattttctctcgatgatctggaagtggacgatgagctggcaaaaaaaatccagagaaaaatgcgggaattggtgagacaggatttaaagatcaaaaaaatttcctacaatacgttcgaggcaaggaaaaggtttgcggggcaggggatgaaagaaaaagtgagactctttcggttccgcagggtttcgaggaccaatgtctattcgctggacggatatgaaaattatttttatggctatatggcgcccagtacgggatatatccaggatttttatgtagatgcgtatcagggaggaattgttcttcagatcccgagacgggatcatctccattccgtctcaagatttacgcctcagccaaagctgtttcatgtgatgcagaggtccagatcctggagcaagcttatgagagtggacacggtcggggctctcaacgaagagatcaccaacggcgatatcaataacctgattctcgtgcaggaggcccttcaggagaagcttctggctgatattgcttcaaagatcgtggacgacgggaaaaaggttgtcctgatcgcaggtccgtcttcttccgggaagacgacattctcccaccgccttgccattcagcttcagatcgacgggctcactccgcacccaatttctctggatgattatttcttagacagagagctgtctcccagggacgaggagggcaactataatttcgagacgatcgcatctcttgatctggaattgttcaacgaagatatcaactgtcttttggccgggaagcaggtacagctcccaacctataatttcgtttcaggaaaacgggaatacaaagggaattataaaaagatcggaccggatgatgtgctggtcatcgagggaatccatggcttgaacgggatgctgtccagtgagatttcggaagaagacaaatataagatttatgtcagcgcgctgagtcagatcaatatagatgaacacaaccggatacccagctccgacggccgtctgttgagaaggatcgtgagggatgcaaggcacaggggaacggatgcaaagacgaccatcggacggtgggaatctgtgcgcaggggtgaggaactgaatattttcccttatcaggaggaggcagatatcatgtttaattctgcccagatttatgagctggccgtgttaaaacagtatgcagagccacttctgttccagatcagcccgggctgtccggaatatcaggaatccaagcgcctgctgaagtttttggactacttcctgagtgttaaaagcgaggatataccgaagacgtctcttatcagagagttcatcgggggaagctgctttgagacttgacggatcagtttttttatctaactaatcgggatgaacccctatcttaattaatgagagagaatttttttacgaagaattatagaatatattcggctttgctgcagccgcagacagataagaacagaaaaaaggcggcacagctgcagggctcatatacggcagagcatacttggctgctggctctggctcagaaatgttaatgacctttgatacggaacaggaaattaatagaaattaaagggatttgagttagatcaaatcgtctctgacaagcagacccaaggcagttcaaggggaagaaaaaacgcggagggaagagtacagtccaccgcagaaaaagaacagactcttttagatgtcagagagggagatattcggattaaaaagacaggtgccacagtcggaggagtatctaaagacggcggcattctgcatcctaaaggctattgaattaccggaacgacgacggaacacaacattgtggtcgaaaaagaggtaagaacagagcttaccttgtgtgtcaaaggaggaaacataaatgaaaatggagaagaaacgaaatggaattatcaggagatccagagaggagaggatcagctgcggcggaaaaaaaacaggcgaggcttcagcagcatcggcgaaaacagggcaggtatcgaaatttggctgggtacttataagccttctgggtgcctcagggatcataattgatattaagacgaagaaaaggaatccctaaatcgtttgacggaacatacaagaacatggtataattccactcggaatttagttaaccgaatgatcgcgccaaagtattttggtgaggaaagtccgggcttcgcagggcaggatgccggataacgtccggtaggggtgaccctcaggccagtgcaacagaaataaaccgccggcgatcgccggtaaggatggaaaggcggggtaagagcccaccgcttggctggtaacaggcaaggcacatgtaaaccccatccgaagcaaggcaggagaaaagctatgggcttgcccggtccgcttttcggtgtgccgctggagcttgctggcaacagcaagtcgagatagatgatcatttaagacagaacccggcttacagattaactaaattccatttttattgaaatagaaatttttcagacaagacatcagaatccagggatgaaaacacagtggagcctaagacgaacgaacagattggagcaaatcatattataagtaaaactggaggaaacggatttacatataagcagttaaaacaccttacgaaagatccaaagacagaaaaaataagaattagaaatataaagagatcaagaaaaatggacagacagcgaagaaaggagaagactctaaagctgtatggatgatgctgagaggattgttgtacagcctgaacaggagaatgtagcgtcctgcggtttgctgctgtcctgtggatttgatttaaatacagaaaatgacatatatgttatgacgatataaatgctgctatgtaaaagaatgtagatgtatctgaaattggacttaaattttacaaaagtgtgaataatgtttcaaaaatgtcatacactatattaaaggagtgtatatgacattgaagaaaaaatggaaagtagcagccatatcttgtgcgattggcttatgcagcgtagggcagcaggtctttgcaagtgatactttatttcagccgccgcagggcgaaaatggcgttgatcagcttatccagaggaaactgttggaagaacagaagcagtttaaagagcgaaaagcactgattaaaaagttaaatatagaacgtcagattgaaaaagtacaggatgtcaaaggcctcaaaggaaaaatatctacaagagagaaagcaatccttactaggatcgtggaagcagaagctactgacaaagacatgaagagtaaaatcttagtcgcaaatgtgataataaacagggtccgttccaaggaatttccaaacaccatcgaacaggtcgtgttccagaggaccaatggcagcgtacagttttctccgacagccgacggacggtataattcggtgacgatcaaagcgtctacacgagaaagtgtggagcgggcgctggaaggagaagactactcagagggcgcgttgtattttgtggaaaagacaatggcgaatccaagaaatgtgtcctggtttgacagggctctgacgaaactattcacttatcagggacattctttttataaataagagttaaaattcggggttgacacgaaaaaagaaaagtattatcattctatcatatagtgataaaccgatgagaaagagtagtagtcaggatcagaaggattttaagagagctgcagatggtgggattgcagcatgaattccctgatgaatggactttcgagggcagttctgaaccacagtaggagttgccgggcacccgacccgttacacaacagggcatatatgatggtatatgaaaagagtgggcattttttatgatgtcaatttgagtggtaccgcggatatccgcctcaagcattagcttggggcgttttttattccacaggaaagttctgagaacctttctgcggagagattcgctcctgccactactatgaatgtttatctctataagtgcaaaaaatcaattgtagagaaaaggagaagaagttatgaaaaagagattattagcagcaggatgcagcgcagtattggcagcaacattattatttgccggatgttcaaaaaaaagtgaggacaaaagctatcagatcgggattcagcagtttgcagagcatgaatctttaaataactgccgcaaaggttttatccaggggttagaaaaagaaggaatcaaggaaggaaaaaatttaaagattacttataaaaatgctcaggctgataccgctgccgataaccagatcgcttcaaactttgcttccaagaagatggacctgatctgtgccattgcgacaccaagtgcccagagcgcatacaatgcagcttctgattctaagacaccggttatctacactgcggttacatcaccggaactggcaggattcgtagacaaggacggaaaaaatgtaggggaagttacaggaacttctgatctgatccttgcagataaacagctgaagctgatccgtaaagtgcttcctaaggcaaaaaatgtaggaatcctgtacagcacaaatgaggttaactctaaagccggaattgaagcttatgagaaagtagctgagaagaacggtttcaagattgttactcagggaatcagtgcggcggcagatatgccgatggcggcggatagcctgattaaaaaagtagactgtattacaaaccttacagataatctggtcgtaagctcaatgccgacttacctggaaaaagctaacaaggcaaagatcccggtattcggttcagagatcgaacaggtgaaattaggatgtattggatgcgtgggaattgacttcgtaaaacttggagaacagacaggaaaaatggctgccaaagtattaaagggagagaagaaagcatccgaaattccgtttgagacgtttaatcagggagacatctacctcaatgaaaaaacggcaaaagaccttggaattaaattaccgtcagatgtaaagaaagaggctgtagaaacatttacagaaattaaagcaagcaaataaataggagcaaaaaatggaacaactgatcattggcgtcttcgagcagggattcatctatgcggtgatggctctgggcgtatacattacttataaaatactggactttccggatttgtctgtggacagtacctttccgttaggtgctgccatcaccacggtactgttgatgaatgggttcaatccgatactttcgctgatcctttcaacagcggcgggagcggcagcaggggctttgaccgggatcatccacgtgaagttcagagtcagggatctgctttcaggtatcattatgatgacgggactttatacgatcaatctgcggattaccgggggaagtgccaatgtgcctctgttcaattacaatacgatttttaacaatgattttatcaacaaattatttccggaggcgcttgagccgtataagacactgatcatcattacactgatcatgctgatcgcaaaactcctcctggacttgtacttaaagacaaaatccggatttctgctcagagccgtgggggacaatgaaaaaattgttacgtcactggctaaggacagcgggtctgtaaaaatagtcggactttccatcgctaacgggctggtagctttggcaggcagtgtcatgtgccagcagcagagattttttgaaatctcgatgggtaccgggactatcgtcattggccttgccagcgttatcatcgggacgaacatttttaaaggaaatattctgaaggctacaacggctgttatcatcggatctgtcatttataaggcatgcgtggcagcagccatcgagatcggactggattcccaggaccttaaactgatcactgcgatcctgtttcttgtgatcctgatcatcagtatggaccggaaaaagaaggtgaaagcatgattgaacttaaaaatattgacaaatattataacatcggaacggtgaatgaaatctgtctgtttaaagattttaatttaaagattcagaacggtgatttcgtttctgtgatcggcagcaacggatcagggaagacatcaatgctgaacctgatctgcggaagtctccagcccgagaacggatcaatcagccttggcggtgaggatatcacaaagcagaaggagtttgtccgtcagagaaagatcggaagggtatatcaggacccggccatgggaacatgtccttccatgacaattcttgaaaatatgtctctggcagacaataaaggcagggcgtatggactcggactgggcacaaataagagaaggatcagccattaccgtgaaatgctttcccagctggggttagggctcgaagatatgatgggaacaaaggtcggcgccctgtcagggggacagcggcaggcaatggcacttctgatgaccacaatgacgccgattgagtttttgatcctggatgaacacacggcggcgctggacccaaagacggcggaactgatcatgcaactgacggataagatcgtcagggagaaaaacttaacgactgttatggtcacgcacaatctcaggtttgccgtggaatatggaaaccgtctgatcatgatgcaccagggacaggcaattttagacaaggcaggaaaagaaaaagaaactttagctatagaagatttgctggatcagtttaatgagatcagcatagagaccgggaattgagtgaatatatacagatgtttggtgatgtttaacagggatatataacccagaaaaaatcggcatagtcgtgattatcggctatgccgatttttcttttgtaataattcacttgcaacagcacctcccaaaataagaacagcacccagaagctgtacagccgacaggcgctctctgagaaagaatgctgagaatatgagtgccgacagtggttcgagatatccacataaaatggccaaaaaccgtggatgttaactttagttgacatatttccaacggcatttggtggaaaaaagagccacagttcttatgatatatataaacagacagaggagatagcctatgaaaattctataaaaatttaaatcgtttaagaaaagagaaagactggtcacaggaagaattgggaaaccagctgtatgtatccaggcagaccgtatccaagtgggaactgggagtttcccaaacaaaaagatattgagaaatagcctgtgtttacctgcttgtaaataaaaaaatattgttactaagcttagagatactacataagcgtgttagtatctctttttcgttgcggtaaaacagcagactatttcatttccacttgattatcctaaagcttattggtctatagtttgtcaagggcttgttgcatgagtaatgctgaatagcaccctttacaaagcacaggctgataagtaacttttcaaaaacagaaaagaaatgacgatattgaagtatcatgctataatgtacacaaagacaaattctttaggttagaatcgatgatggggtaaacgaaaaagcagttttggcattccagtgaactgccccttcgtttacaccattttcgatttggcctaattgaacaaagtgagtgtccagataaccactacctatggactttcaatcttttgcccttacccgtgattatacaggattttctgtacagaagctacagaaatcaaatattttcagataaataggtacgacaacaaaacctcaaactttgaggcttcagaaaaaatatggaagaataaggctttaacatctttgtggttttcggaactgtggttttccaagatggccgccacaggctttacatacacagacatttatcccataaagctgctttagtatctcaggcatctccttgtcccggagttttgagagatactttttgcatccaaggatattccggcataaagtaagcttctttcgtttgctgcgggaacaaagaagtccgtaatgccgaatcctgacaaaacgttttggcggtacatgcattagaaaccgccgtatgaattcaactccggaaagggtcagttctttccattgtcctttgttccggtaatcttttatagaaaaagtgacgttttcatcatccatgcagatgatgcggtgattgctgatagcaattctgtgggtatactttccaaggtaatcaatcacagactgtgctccattaaaagttttcttgcaataaggaacccattccgcatcataacaggaatcaatcagttccttgaatgcataatggttacggtatttttcggcagttctatgaaacttaagctggttcgtattccagagatttttcaactcctccatatatttttcacgaaaaaccttggagatgacccatatgggaagaaaaaactcagtaccattgtctttccattcgtttttaggtgtcagaccatcaccaagcagtattgtatggatatgaggatgaaagttcatttcagaaccccatgtatgtaagatacagatatatccaacagtagctcccagatactttggatcagtagccagttcactgattgtagcagaagtagcatgatacagggtatcatataatagtttctgattactgtaaatgattggattcagaacatccggcactgtaaatactatgtggaagtacggggcatcaaggacatcctctctgcgggcatccatccacatttcctttggaacagcctgacacatagggcaacaacggttacggcaggaattataatgaatctgaacagcaccacagtcttcgtatacactgacattcgcaccgtaagcccctgttttgcagttcaagatgtttcgggcaacttttgcctgttccggagaaggagaatgcttttcaagatatgctggataaaaacgaagaaagatatcctgcacggttggtttattcatggacagcaccttctttcctgtcaaatggactttggattcccatcagggatttattgctgacatgaagataaacttccgtggattttggatcacggtgtccaagcagtgcctgaatattttgccgttctatcccctgctccatcagatgagttgcaaagctatggcgaagacagtggggagttgccttcttgggaagtccagcatcagatactgcccgacgcatcacctgctccagtgtactgactgtcaggtaattgccagtgaatttattaggaaacaggattccgcggggacgtcctttctcaaaccagtattgtgtaaggatatccaggcaccgcttggaaaggattgtatagcgatccatccggttctttgtatcccggacatggatctgcatatttgagcgggaaatgtcatcataatgcaggtgaatcacttcggaaacccgcattccggaagaatacattattgcaaacatagccttatatttgatatcatcgacagtttctaattgacggtcgatttcatcaatagtcagtactattggaagcttgtgttccagaatcatccgtgggaccatgatgtcatcccaaaggatgtgcaggacattccgatagaaaaaacggatggcagaattataaagattcagggttgtggctttcagcccttcatctattttagcaagcaaaaaagtcctgacatcctgacaggtaagttcctccggattcttaccctgatatttcagaaagtaagagacatagtttttataacagttgatggaacgttctttaagattccggatttttgcggcttcctcaagtttttctaagtatttttcgtacataataaaatcctccatgtaaaatcagtagtatcaaaaagtcactgctttacacggaggcgcatttgggtcataaaaccgcttgccaaccaagcggaagggtgttattcttttcataggcagtgggaaggtcgatcctgtttgattgtttggtgtggtaacttaacaatactacttttaggacttgctttccactgtttttattacagaaaacagaaaatcgctatgtcacagccttggtaggccatcgcgcagcgattttgttcaattagaatttggagtgataaacaatgaaattatttaactggggtggaagagaataaacacatacttcttcgatttaacagactatgaatatttaaggagaacaatgaagtatgagtaaattgattttatttcctgttgcagagcaagaaaagccgctctttattaaacaagtccaagaagcattccaagttggatatgagtctgaatatggcttatgcgatgacataattcttccggaaaaagatattgaagaatctttcacagcgaaaggagcagagacatactttgctttgattgacggcgaaattgtaggtggagctgtaattgtaatcaatactgagacgagaaaaaactatctggatttgttatatgtaaaggttggttgtcagagcaaaggcacgggacaagccctttggaagacaatcgaagaacttcatcctgagacggaggtttgggaaacacatacgccttattttgaaaaaagaaacatccacttttatgtgaacagattaggatttcatatcgtagaattttataatcaatatcacaaagaccctcatcaaaacggagagcctgccggcggaatgccggaagaaagaggatatgattttttcagatttgagaagataatgaaatagacaacttccagttgtgcgcccagcaaagggcaattaacccagcaggtgcaaatcctgtctgcgaaggtccagccaaccagcagtagccagaactgttcggcactgcggggtcaaagagccagtcatgcttgacattgtggttagttgtcaactggggagagcctgacacttcttggagacaagtacgtcctatcaactagaagatggagatggacggatgggcggcaggcagtcggatagcttcatagtaccggggagaccgggtaatgccggtggagggaagggggctacatagtaacggtctttctgaggacacatcaaccgtgcccaggaacggaggtattgatgggaacgaaattagagagaatagcagaaatatcggagacaacgccgaagccggagttcacgtctctatatcacttgataaatgctgaaatgttaaaacagtgtcataaataattggatggaaacaaggcagtaggcatagacaaagtgacgaaagaagagtatggggaacatctggaagaaaacattacaaatcttgtagagcggctgaagaacagggcatataagccactgccatcgctaagagcattataccttacaaaaggctttaaattggctgcaacgacaggtagcaccaaccataaaaatggtacaggaactggacaaggaaaaccatacaacgacactgaaagatatgatagaacaggcagaactgaaagacaagcactaagtaaaatggaacaggacatggtaggtgctgaaaagtggattgagttaatcaaggaatattccgtaccaaaggaactgacagcaccattattaaatgcaatgatagaaaaaatccttattcatgacgcaacaacgaatgaggataacgaaagaatacaggaaatagagatatattaccgatttattggaaaagtagactgataatgagggttcatatctttaactaagggaaagcgggactacaacaccggagatgaagaaactgatggaattgagcagaatttttcatatcagcatggatgagttggttggaaattctggtgcatcgggagaaaaggaagcagtctatgtgactgtgaatctccactatgaataataaagcaaaaggaatcatagccattggaaactttgctgctggtcttttctccgtgggtctgctctctgcggggctgatttccataggagaatgtgctttagccacccacattgctgtgggaggttatgtcaatgcacacatagtcatcggaggagctgctgacggaacatttactttcacagaaaaagggacggcagcctgcgaagaaatcagacaaacgatcctgagggaatatccccgtatatggaaattcttgatccggttattttcagcagccatgaggtgaaacagaagatagagaagaaaacttggaatttttattccctattaatgaaaagtgtgttatactcatttagttattgtaaatatgtcagacagttcattcgtaccatcctgtctttaaacaaaactaggacaaaataagaggatatgatcagacatatttcttatgtcttagatgaatgcttagagacacggacaccgcgggtggcgtgtcttttactgtttcatggggttcttttcggaagaaggcctgaaacagcgggaaatagaaaacgagagaaagggataaacatgtaccagttaaatacacatgcgtcttttgactccgcacattttctggcgggatacgagggcaagtgcagaaatctgcacggacaccggtggaaactatcggtgacgatccaaaaggaaaaagtagaagaacagggccagaccagggggatggtcgtagacttcggcgaattaaaggacaaggtaaaagaaatcgcagacgagtttgaccatgctctgatcgtggaaaaagacacactgaagaccaagacgatagaagcactgagagaagaagatttccggattattgaagttaaattccgccctacggcagagaattttgccagatatttttatgaccggatcaaacaggacggctatgacgtttcttatgtggaagtatatgagacgccgaataactgtgccatttacggagaatagcgatggaagtttttaaaatagcagaaagctttgtgagtatcaacggcgaggggaagaaggcgggccggctttctatgtttattcgccttcggggatgtaatttaaactgttcctactgcgataccaaatgggccatcagcaaaaaaggtgaggcggatctcatgacggctgcggaagtggcgcagatggtaaaggagtcagaagcagatctggtaacattgaccgggggagaacctctgctggatgaaaatatcagcgaattgattggaagtattttgtcacttccaaagacagaactggaaattgaaacgaacggaagtattcccatccgcccatggagagagcgggatgcgagattttcgatgacgatggactataaactgccctccagcggcatggaggagtccatgtaccttgaaaatatggaagaattaaagccgtgggatgtcgtaaagtttgtgatagggacaagagaagatctggagaaggcaaaagaagttatcgaacggttttctctctgtgaaaaggcgatcgtgtatttcagtccggttttcggtgccatacctccggatgagatcgtggagtttatgaaagaacacaggatgaataaagtcaggtttcagatccagatccataaagttgtctggaatccggagcggaagggagtctaagaagctatggcaatcgataaagaagcagtcaaaaaacatatcagaggtatcctggaagcgctgggggataatccggaccgggagggtcttaaggagacgccggaccgtgtagccaggatgtatgaagaagtgtttgaggggatgaattacagcaatgaccagattgcagaaatgtactctaaaacctttgaggacgatctgtctgtaaaaaatcataaggatatggtcgttgtaaaagacatcgatatattcagctactgtgaacaccatctggcccttatgtacaatatgaaagtcactgtggcatatcagccgaaagaaaagattctgggactgagcaagatcgcaaggatctgtgacatggtcggcaaaaggcttcagctccaggaacggatcgggtcagatatcgcagagatcatctccaaagtggcagggacagaggatgtagctgtgctcatcgaaggaaatcacagctgtatgagcgccaggggcattaagaaaaatcaggcaaagaccattacatctacgttgagagggaagtttgaaaatgactctgccatggagaaccgcttttatatgctcgcagaaagataagaggaggaaagaaaactatgtcaaaaccgacaaaagcagttgtagtattcagtgggggacaggacagtaccacctgtctgttctgggcaaagaaaaaatatgaagaagttatcgcgctttcttttaattacggacagaagcattcggatgaattgatttgtgccaaagaaatctgcaaaaaatatggcgtagagcatcatattctggatatggccctcttaaaccagctggcgcccaactcattgacgagggcagatattgaggtggacaaagaggcgcctgaaacgggtacgccgaattcctttgtagacggaaggaatatgctgtttcttacctttgcggcagtatttgcaaagcagagagatatccatgtactggtgaccggcgtgtcccagagcgatttcagcggatatccggactgcagacatgtatttattacgtctctggaaacgacgctgactctggcgatggattacgagtttgaagtgattacgcctctcatgtggatcgacaaaaaagaaacatggaaaatggccgatgatctgggagtatttgatgtgataagacatgaaacactgacctgctataatggagtcaggggggacggatgcggagaatgtcctgcgtgcagactcagaaggcgggggatggaagcctatctttcggagcgaaagaaataaagaacaaatgtcaatgtcatatagtcaatattagaacatttgtgtgagtgtgtttttgttgcagatttttattgataaaacattaacaaagcagtacaataagaatgtaaccattggtcagggttgtcaacatttcaatcctctgcagcaaaggagataacgtatgggaagatttacactacctagagatttatactttggaaaaggatcacttgagtcactgaagacattggatggaaaaaaagctgttttggtactcggcggcggttctatgaaacgttttggatttgtagaccaggttgtcgattatttaaaagaagcaggagttgagacaaaattaattgaaggtgtagaaccggacccttctgtagagactgtgtttaaaggcgcagaggtcatgagagactttgagccggactggattattgcgatgggaggaggatctccgatcgatgctgcgaaggcaatgtggatcttctatgagcatccggaaactacatttgacgatgtaaaagatccgtttacagttcctccgctcaggaataaagccaaattccttgcgatcccgtcaacatcaggaacagctaccgaagtgacggcattttctgttatcacagattacagttcaggaatcaaatatccgctggcagactttgagatcacaccggatattgcaatcgtagatcctgcattggcggagacgatgcctccgaaactgacttcctatacaggaatggatgcactgactcatgccattgaagcatatgtggcaggacttcattctccgttctcagatccgctggcattagaagctattgagatggtgtttgacaacttaaaagcttcctacgaaggggatatgacagcccgtgagaatatgcactatgcacagtgcctcgcaggaatggcattctccaatgcacttttgggaatcgtacactctttggctcataagacaggagccgtctttgacaccggacatatcacacatggatgtgcaaatgccatctacctgccgtatgtgatccagtttaacgcgaaggtttgtgaggaacgctatgcagctatcgcaagaaggatcggccttcctggaaattccgataaggcattgactctttcactgatcgaggccatccgcgagatgaataagaaattaaacattgtttccaatctgaaagattttggaattaatgaagaagaatttaatcagaagaagaggatgatcgcagagcgcgccgtggcagacgcatgtacgggatctaatccgagagagacttccacagatgacatggaaaaagttttggaatgcatctactacggaaaagatgtaacattttaataaatatacataatcgaggccgggacagtttatgtcccggctgttcctttccttgtaagaagaagctgggcagcaaacataatttgtgatggagaatcagtcaattctattcttgcatctgataaaataatattggctgcgcccatttatagttggtcgtgtccagcacctgtgaaagccttgcttgatcggcttgtatacgaaggtatgctgtcagaacgtgatttgggatacaatagtggatttatcagtgataataaaactgatagagcaagagcatttgccaaaaatttattgaatagatgttagtgattcttattgcagcaaaacggcgctgtgctgcgattgtttactgaacagaccttcttttcagtcttgaactggagattttattttgtagaataatctgataattatagattgtaatttaaattttcaaataatcagaaaacttaagaaaaaaatgctttacaagttagatatatttttgtatgatagattccaacaaagaaattctacaaaaaataacatttcgaaactgctgaatgaaaggaagagatttatgacgatcaaaagagacaacacacccgggttatacgattccagctttgagcatgacaactgcgggatcggtgcctgtgtcaatatcaagggaatcaaaagtcatactacagtcgacaatgcattaaagattgttgagacactggaacaccgggccggaaaagatgcggcaggggagaccggagatggtgtcggcattatgctccagatttcccataagttttttgaaaaggcatgtaaagagtccggcatcggaatcggaggagagagggaatatggagttggaatgttcttttttcccaatgatgaactgaaagtacagcaggccaaaaagatgtttgagatcatcgtggaaaaggaaggcatgaagttcctcggatggagagaagtgccgaccgacagcacggttttgggcaaaaaagccattgaatgtatgccgaagattctccaggcatttatcgaaaagccggaggatgtggagaaaggattagagtttgaccgcaggctgtacattgtccggaaagtatttgaacagagtaatgaagagacctttgtgatttccctgtccagcaggactatcgtatataagggaatgttccttgtgggacagctcagaacattttttaaagaccttcaggacccgggctatgaatctgcaatcgccctcgttcattcacgtttcagtacgaacacgactccgagctgggagaaagcgcatccgtaccggttcatcgtacataacggtgagatcaatacgatccgcggaaatgcagataagatgctggccagagaggaaaatatggagtctaagttcctgaagggccagatgcataaggtaatcccggtggtcaatccaaacgggtccgactccgcacggcttgataataccctggaattccttgtgatgagcggaatggccctgccgcacgcgatcatgatcacgataccggaaccttgggaaaacaataaagtcatcagccagaagaaaagggatttttaccagtattatgcgacgatgatggagccgtgggacggaccggcctccattctgttcaccgacggtgaccaggtaggagccgtgctcgaccgaaacggcctgcgcccttccagatactacatcacagatgatgatcagctgatcttatcttctgagatcggagtcctggatatcgaccctaccaagatcctcgtgaaagaacggcttcgtcccggaaagatgctcctggtggatacggtcaggggcgaagtcatcgatgatgatgtggttaaggaatcttatgcgggaaaagagccgtacggagaatggcttgacagtaacctcacagaactcaaggatttaaagatcccaaatcttccggtgccgtcttatgagacagagcagagagaaaaacttttaaaggcattcggatattcttatgaggaagtaaaaactgccattcagcctatggcgttaagcggctcagaggctatcgcggccatgggtacggattctccgctggcggttctctcaaagaagcatcagcctctgtttaactattttaaacagctgtttgcacaggtaaccaatccgccgatcgacgcgatcagagaagaacttgtgacttccaccactatttatgtcggaaaagacggaaatatcctggaagagaaaccggataactgccaggtgctgaaagtccacaatccaattcttacggacacagatctgctgaagatcaaatatatgaagagagaaggctttcaggtagcggagcttccgatcgtttattataaaaatacatccctggagaaggctctggaccgcttgtttgttgaggcagaccgtgcttacagggacggagcaaatatcattatcctgtctgacaggggagtagatgaaaaccatgtggcgatcccatccctgcttgctgtatctgccatgcaccagcatctgatcaagacaaaaaaacggacttccgtggctctgatccttgagagcggagagccgagagaggttcatcattttgccacgctgctcggatatggagcttgtgcggtgaatccatatctggcactgcaggccatccggaagctgatcgacgatgacctgcttcacaaggattattatgcggctgtggaagactatacaaacgcagtccttcacggaatcgtaaagattgcatccaagatggggatctccacgatccagtcttatcagggatctcagatttttgaggccatcggcattgactctaaagtgattgataagtattttaccaatacagtcagccgcgtggaaggaatcaccctaaaggatatcgaagaagatgtagacatcagacattcatctgcatttgacccgctgggactggaaaatgacctgatgctggagagcacaggcagccataaattcagaagcggaaaggaacagcatctttataatccgcagacgatccacacgctccagatggcggcgagaacaggaaattacgagacctttaaaaagtatacccacatgatcgatgaggaattagagcccggaaatttaagaggcctgatggagtttaactatccctcaaagggaatacctatggataaggttgagagtgtggattccattgtaaagagatttaagacaggagccatgtcttacggttctatctcaggagaggcccatgagacactggctatcgccatgaatatgctgggcggcaagtccaacagcggagagggtggtgaacgcccggaacggctggctgtgggaagagacggaaagaaccgctgttctgccatcaaacaggtggcatccggaaggttcggagtgaccagcgagtaccttgtaagtgcgaaggaaatccagatcaagatggcccagggagcaaaaccgggagaaggggggcacctccccggaaagaaggtttacccgtggattgcaaagacccgtcattcaacggcgggagtggggctgatttcacctccgccgcatcacgatatttattctatcgaggacttggcacagctgatctatgactgcaaaaatgccaacagagatgcaaggatttccgtgaagcttgtttccgaagcgggagtcggtacggtcgcatctggtgtcgcaaaggccggggcccaggttattctgatctccggttatgacggaggtacgggagccgcaccgagaaactctatttacaacgccgggcttccgtgggagctggggcttgctgaggcgcaccagaacctgatcatgaacaatttaaggaacaaggttgtactggaaacagatggaaagcttatgagcggaagggatgtggccatcgccgccatgcttggggcagaagagtttgggttcgcaacggcgccgcttgtgacgctgggatgcgtaatgatgcgtgtctgcaatctggatacctgccctgtgggtgttgcgacacagaatccggagctccgtaagcggtttgccggtaaaccggaatatgtggtcaatttcatgcggtttatagcacaggagctgagagaatatatggcgaaactgggcgtggccaccatcgatgagctggttggacgcacagatttgttaaagccgacaaaagagacacaagacagacacattgatctgtcaagaatcctggatacttcctatgccaaggcagaaaagattgattacacccataagaaagtctatgattttaagctggataaagtggcggacgagacggttcttctgaaaaaactgaaacccgcacttgagaaaaaacagagaaagagcatcgaactggatgtcacaaacatcgaccgtacgtttggtacgatcttcgggtccgagatcaccaggcgatggggagaaaacacgctgcctgacgacatgtacacggtaaaatgcagtggtgcgggcggacagagcttcggggcatttatcccgaaaggcctcacactggaacttgtcggggacagcaacgactactttggaaaagggctgtccggaggaaagctggtggtatatccgccggccggcgtcaagtttaaaccggaagaaaacatcattgtcggaaatgtggccctctacggggctaccagcggcaaagcatttatcaatggagtcgcgggagagcggttctgtgtcagaaattccggggctgctgccgtagtggaaggcgtgggtgatcacggatgtgaatatatgaccggaggccgtgtcttagtcctgggtgagacaggaaagaattttgcggcaggcatgagcggtggtatcgcctatgtcttagatgaggacagttccctttatatgaatgtcaacaaggagatggtgaccatcgaaaatatcacctccaaatacgatgtgcttgaagtcaaagaaatgctgaaagaacatgtggcttataccaattccgaaaaaggaaagaagatcctcagaaactttgaagaattcctgccgaagtttaaaaagatcatgccggtagactataaacggatgctgaatctgatcgtacagatggaagagcggggactcagcagtgagcaggcgcagatcgaagcattttatgagaacgctaagtaggaggacagacgaatgggaaaaccaactggatttatagattacgagagaaaagacgcgagggcggaggagcccagagagagaatcaaacattataatgaattccacattcctctcccgactgaagagcagcagagacagggagccagatgcatggactgcggtgtaccgttctgtcagtcaggactgatgcttggcggcatggcgtccgggtgtccgctgaataatctggtgccggagtggaacgacctgatttatacaggaaactgggaacaggcatttgagaggcttaagaagaccaatccgtttccggagtttacaggcagggtctgtcctgctctctgtgaggcggcctgtacctgcggcctcaacggggagccagtctgctccaagcagaatgagctgagcattattgaatacggctatgccaacggacttgcggatgcaaaactgccaaagagcaggaccgggaaaaaggttgctgtaatcggttccggacccgccgggctttcggcggccaattcgctgaacaagagaggacatcaggttacggtctatgaacgttcagacagggtcggcggactgatgatgtacggtattccaaatatgaagctggaaaagcagatcgtggaccggaagatcaaaatcatggaggaagaaggcattatatttaagacgaatacggatgtgggaaaggatgtcaaggcggaacagctgaaaaaagaatacgacagcattatcctggcatgcggttcctcccatccgagagacatcgaagttccgggaagggatgccaaaggcatttatttcgccgtagacttcctgaaatccaccacgaaagcactgctggacagcggactgaaagacaacacttacatcagtgccaaagggaagaacgtcatggtcatcggaggcggcgacacgggaaatgactgtgtgggaacatccatccgccacggggccaagagtgtcatccagctggagatgatgccgaaactcccggatgagcgcacagagaacaatccgtggccggagtggccgagagtctgcaagacagactacggtcaggaggaagccatcgctttattcggccatgatccgagaacttatcagacaacagtgaaagaatttaagaaaaacaaaaagggtgatgtatcgaaagccgttatcgtaaagcttgaaagtaaaaaggatgagaaaaccggtcggatgacaatggcggaggtccctggaacagagaaagaaatttcggtggatcttgtgctgatcgctgccgggttcctcggaagtgaatcctatgtgaccgacgcattcggcgtaaaactcaatgaacgtaccaatgtagccacagagccggactctttttgcaccaatgttaaaaatgtatttaccgcgggagatatgcaccggggccagtcactggtcgtgtgggcaatccgcgaaggacgggaagcggcgagagaagtcgaccttcagatgatgggatatacaaacctgtaatatgttttacatttccggagacgaagccagtttggttttgtctctggtttttttcgcattttttccgtataataaaaagaaaacttaatgggaaggacggatcagcgagttgaaagaatataaagaactgtttttaaccttttttaaaatgggtgcatttacattcggcggaggctacgccatgctcccgatgatcgaacgggaggttgttcaaaataaaggctgggcgacgagtgaagaagtcatggattattttgcggtaggacagtgtacgcccggagtcatcgctgtcaatacctccacgtttattggatacaaactgaagggtatcagaggaggtatcacggcgacattagggtttacagccccatcattgattattatcatgctcatcgcagcttttatgaccaatttcagtgacctaaaagcggtgcagagtgcattttggggcattcgggtctgtgtctgtgttctgatgatcaacagtatcaagaagatggtaaaaggcggagtcgtggactggctgacgggtatgatatttgcggccacatttttcggcatggtatttttcatgagtaatcctgtgatttatgtaatcatcggcgctgttttaggacttttgctctgcgggaaagtgcggagaggaggagatagaaaatgatccttctaaagctgttcattgaattttttaagaccggactctttgcgcttgggggcgggcttgccacacttccgttcctttacagcatggcggaccgttttcactggtttacccacgcagatattgtaaatatgctggcaatttccgagtctacgccgggagccatcggcgtcaacatgtcgacttattcgggatttcatatcgcaggtatccccggaagcctgatcgccacattcggccttgtgctgccgtcggtggtcattatcatcctcgttgccagagtgctggaaagttttaaaaacaaccgtcttgtggaggcaggattttacggcatccgtccggtggtggccggattaatctgcgcggcgactctgtctgtgtttcaggtggcgtttttaaaagatggtgaactggatcttcataaaatagtttcttccattgactttaaatctgtgattctttttgttatattatatatgataaataaagtagcagagaaacgtgggaaatccatacatccgattttcctgatcgtgttgtcgggatgtatcgggattgccgtgctgggagcttgattatgcatattttaggacactttaagacaattacaaaacataaaatccttgtggccaaaggctgttttaaggtgggactttactaccagggtatcatgcacgatatgtcaaagtattctccgacggaatttattccgggggcgaaatactaccagggaaatcaaagccctaacaacatcgaaagaagaaaatatgggatatccagggcatggctgcaccataaagggaggaacaggcatcattttgagtattggatcgattacagcctgaatcctgacgctaagggcctggtaggaatgaaaattccgaaaaaatatatggcggaaatgttagtggacagaatcagcgccgggaaaatctacaaaaagaatgattttacgaaagagagtcctctggagtattttaataacggaatcggggcattgatcatgcatgaggcttccaaagattatctgatgatgctgttgacaatgtatgctgaaaaaggagagaaggagacatttcgctatttgaaaagagacttgaaagaggacatcagcggctatgaccgcatttctccttttgagaaaacaggcccggtgccgattggctagaatttcatgtatgtacttcttgaaactctcacatacttcatgtataataacttgtaaagaaacggaataaacggcctggggtgttcgataacgcctgctattttgaacctacaactatttgaacgggattccgaatatccggctggatatcaagccacaacacggtggaaggtagaaggcaggatgaggaaacccacctagctgtggctaggagtcaaaattgcggggaacggcatcttgggcataacaaaagataagttaaagagactgcaggctgagccggcagtctcttttgagtttgcgcgccatgggcgcactctaacgggtgaaagtcccgaacatgcccgggtagtgggaaatgtatagccgaacagcaagggtgtccatcgtgagatggaatctgaaggaagctgaaagcaaacctccggttcgacggacagaaatcgcatataaggctggactctgagagataagttggctcaaagcaacaaagtctaataactatcacatttgtaggagtaaagtaaatgcggcggatatatggagggaaagagcatgcaccttaagcatggaggtctcacagaggtttcattagcctaataacaacgaactgtgagaagtcagcagagcccatagtagtgaagaagtttctgtaacggaaatggagcgaaggggtgaacagtcaatcagttttagtagagtctggattgcagaagagacaacatctgccgtaaccaatcggggaaagggtggtcaattcaagcgagacgggaatctgtttgcgcactggaagtttggaatactgccatcggccggataatgggagctgtatgagctgagaggttcacgtacagttctgagagggacttagggggaggttccctgggtctacttactgtattgttatggtaggaagtgaaatgtcggcaaagcgagtaatgagaaatctcacaaagtttattgaagagaaactagggcttaaatacctcggctttgggttctgctttgacagcagggcacatcaattcaaggcaaaaccacacgcaaaatcgatagcaaagttcaaggcgagcatgaagaaactgacttgccgtagttggggagtaagcaattcctataaggtgaagaagctcaatgcagagagtcctgacatatcgtgatccgcgcaggcggcaatattgatgatcataagacttaaaacagggcgtcatcatataaacaggacttttgtacattgttaagataagggtgcaaaagtccttgttttatttgacagacagactggaagaattgatggaaaaaaacggataagtctccctgcgaacatggtcaagataaatctggccgatggggacgggagtttcgtggcctgtcaggaagatattttccttatccgcatctaaaatataggagaggtttacgatgtaagaacggtggacacggataaaacctttgtttttaacagactgttctatgatattgagtttggaatagaattcaaaactccggtctttaaaatgtacaaccacgaggcgtccgagagtctcaaaatgagaaatatcggaaagctgaatgcactggaacgtggtccggtttttacagacgatatacggcttctttttttgcttgaaaaccgagtaagcattgagaaagacagattcgcccctgataaagttcagctttgacttgatgatgtaattgaaagggtaagcggcaaagcagtcactggcacattccgcgcggactccgagaaagatcacgagtccccacggatcatactcgtggatacggagaaccgtgtcaatcccgcttatgtctttcagtccggcttcaacaaaataaagatcaaaaaagtggtttgggttctctaagtaaacaagaaactcctcacccgaagaaaatgcccgaatactgacagggatctgatgtctctcggcgatcaactcaaaaagttctatgtacttatgcagtgttgcgggagtatcatcacaaaagcagattgaaaacataatatcaccttcttaattcttatagggtgtagattttaagctgtgacaacatttttcgtacctgacttaaataggtggttcctatgggcagagtaaatccattcgtcagccgtaccgtgcggtcagtaatctggtcaatatggcgcatgttgatgagaaaggatctgtgaatgcgcagaaatcctttcggtgttaattctttttccagcctggacatggacatataaaacgaaaagctggtgttgctgtggtatacagttgtaatcctctgaaagatttcaaagtagtaaatatcacccagaggtatgtaatgttcatgcgcgccgctgccgcactggaacaggttgttccgcctcctttcggccagtgaaagagcttttaaatatacaggtttgaattgttccagagtcagatatttgagatagaaaaagtaaaaaggaaacgtagggaaagtatttgcagcaagctgtttattggcagagataaaaataagcagggcatgacagcaaagcttgcggagacttttggccgcttcaagaccgacaatctcatcgtctttgctttttgatattctcaggaaaataatatctgcccgttccggatgagatgacagatcaaataataattcgtctttattggtgtatttaaatatatggatgttaaagtggtgctctgaagcaatgtctttcaatgtttttatatgatcttcggaggagttccgattattgttaaaagtgtaaatgttcattggcatatactctccatttcgcattttgtacttctctattttaccatggaaaaagttagaagcacaacaagaaaccgaatctttttaaatatgtctggatatctgtttttattttcggtataattatttaatatcttttaaaaggagcagtatcatatgaaattttataataaaaacacacagggattctttggacttgtggcgtttggagtacttctctatttgggtgtcagcaatataagctacatattgaaggcattctcctatttagtctcagtgattttcccgtttattatcggaggatgtatggcatttattatcaatgtgccaatgagattttttgaaacaaagctgttttcaaaagtgaaaaaaggaaagcgggcactgagcctgatcctggctgtcgtatgtattatcagtgttctggcgctgatcagttttctcattcttccggaacttgccaatacactttacagcctggcatccagcattccgggatttgtgaacgagatcaaagaatttttacagaatgtatccaacaatcctctgttcaccaaacagaatctgatgaagatcgacttagattggaataaaatcagtacagaactgatgggatttttccagtccggcgccagcaatattctgggctccacggtatctgtcatcagttcggcagtacagaccgtagtgacatttttgcttggcattgtttttgcagttaatgcactgctgaaaaaggagaagctggtacttcagacgaagaaacttctatactcttatctgaaagaagcatatgcggaccgtatcatatacattggaaacatgtgtaatctggcattttcaagttttttgtccggccagtgtacggaagccgtaatcctgggcacgatcatttttatctgcatgaatatactcggtctgccttatgccatgctgatcgccatgtttatcggcgtgacttcgctgatccctattttgggaggattcatcggaagcactctgggggcggttctgatttttatggtaagcccgtttaagatggttatttttgttatcatgtttgttgtagtacagcagattgaagggaatcttatttatcctcatgttgtgggaaattcagtgggtcttcctgccatctgggtcttagttgcagtgaccgtcggcggcaatctggccggagtagccggaatgtttatcagtatcccggcctgttccgttatttatgcgcttttaagggatgcagccaacgaaagactgaggaaaaaagggctgcttgagaaagttcagaataaatagtgtatattccgcggaatttaggtccataatactcctatattatttatggaggtggaaggaatggaccgtgacgatattatctgtccatgtgtcgatgtgaccgtgggagaaattatggatgcctatgaagaaggtgccacaacagtggatgcagtcaaagacgcaaccggcgcaggaagcatctgcggggcttgtcttgacaatattgaagaattacttacagagttaaaatccaaataatttccttacgcatctgtgtacaacccgcggagcgtttttatttcatagggaaggtcgtagaactttcctatgaaataacaaaaggccggagaattgatgagatatcacttctccggccttgactttttttatgggagattctaaaatgaaagtaaatacttgcattacagagagggatgatacatatggacgagaccggtcaaaaaattatagatgcgactatgtctctggtaagggataaaggctacgtggcaacgactacaaaagatatcgcaaattccgcaggggtgaatgaatgcaccctgtttcggaagtttcagaataagaaaagtatcgttatgagcggtatcgagcaggaaaagtggcgggcggattttacgccggatgtatttcaggatgtccggtgggagctgcagtatgatctggaaatgtatatgagagagtatatgaagaggattacccctgactttgtgagactctccatcggcctgcgggctccgcagatttatgaggaaacagcgccgtttattatgaaaatccctcaggcgttcctctcatcgttgatttcttactttgaacagatggcgcagagaggtaagcttcccaggtcggattttgagattttggctatgacgcttttttccagcgcttttggttatacgtttttaaatgcgtcgtttgaagaaaagcttacggaggttgggagagaagactttattaaaaaaacagttgccgcattcctgtatggaattacggcagagtgaagaaggcggcattgtcttttgacggtgccgtataaatataactaatatgcaagtatttacttgctttatgaagtgaatggaggaatattacatggagattacaggagcacagctggttgtgaaagcgttaaaggcggaaaaaacagatactttgtttgcgtatccgggaggtcaggtaattgatttatttaacgagctttatgatgagaaggagatcagagtcattacgccgcgccatgaacagggactagtgcatgcggcagacggatatgccagggcttcgggaaaaacaggagtctgtattgtgaccagcggacctgggacgaccaatcttgtgaccggcattgccactgcaaatatagacagtgttccacttgtttgttttacgggacaggtttcttcagggctgatcgggagagaatcttttcaggaagtaaatacgattaagatcatgaagagtatatgtaaatatgtagtgactgtacgtgaccgcagtgaactggggaaagcgatccgcagtgcctttcaggcagtccggtcaggaaggcccggagcggcagtcgttgatctgccgaaagacattcagcaggaaatgggttctgacttttatccgctgtgcacagacgataaacctgaagtgcctgtgccacaggaagtaatagaccgctgtctggaagctttaagggcagcccgaaaacctctttttttgctgggaggaggtgtacatattgcaggggcggaaaaagaaatggccagtctggcagaaaagaccgggataccggttgtcacgaccattatggggaaaggggtccttccctcagatcatccgctgtatatggggaatctgggtattcacggaagtttcgctgcaaatatggccaccagtgagtgtgatgttctgtttgccatcggcacccggtttaacgaccgcataacaggaaaaacggacagctttgcagacaaggcagttattatccatgcagacatcgagccggatgtgatctcgcgaaatgtaccggcagatatatcggttgccgcagatgcagggaaactgatcagaattcttcttgaaagagcaaagccgtctgcggccggggagtgggtcagccgtctgaaactgtggaaacagcggcatccggtcactttaaagaaaagcacatctggagaaatgagcgcacagaatgtgatagaatacatcaatgatctgtttgacagtgccgtgatcacaacggatgtgggacaaaatcagatgtgggcgtcacagtttttgaaactgtcggagaagagaaaaatgctcacctccggaggtatgggaacaatgggctatggtttccctgctgccataggtgctaaattaggagtaccccgaaaagatgttatagccatctgcggagacggcggatttcagatgaatattcaggaacttgccacggcagcgctctatgaactccccattatcatctgcatcttcaacaacggttatctgggcaatgtccggcagtggcaggagatgttttatgacaggcgttattctgccacatgtacctgccgcagagaaagctgtatgaaagaatgcaaaagtgcgtctgcacactgtctatccggttatatccctgattttgtccatttggcacagagttacggggcagaagggattcgtgtccgggaagtgaaagacattcggagcgctctcctgaaagccaaagagagcaagaatgtccctacggttattgagtttataataggcagagaacagaatgtacttccaattgtacctccgggaaattcactggaaaatatgatcggcggagaataaggggagagatgaaaaacttgggttttcttgttgacattccatgacagagatgatattatattcaaggtcgtcaagacaagccggcgtgtcggaattggcagacgagacagactcaaaatctgttgtccttacgggcgtatgggttcgagtcccattgccggcatagtaaagaacagctgaaaccaataaattcagctgtttttttatttcataggaaagttcacgaccttccctatgaaataaaaacgctccgcgggttgtgcacagatgcgtaaggaaattatttgcctgcggcaaattgcatcaggcacgcaaagttgtcaagcccctcaaagagtgagggaggggttggggcgttgaagtgggcttgcccactttgttccttgcttaaatagtttgttttttatattcctgttaaaggggtttgacagaaagagccggattctttacaatagtgatataacatagtgaaaaagtaggaatgaggagggaacccgtgaagatttcaaccaaagggagatatgcggtccgcttattatatgatctggcacagcacaatacgggagaatggatttcactgaaggatgtgtcaaagagacagggtatttccataaaatatctggagcagatcgtaagacagctgagtatatgcggatatttaaaaagcctgagaggtccgagaggaggatatcagctttctaaaaaaccttcggaatatacgatcggagatgtactggagattacagaaggtagcattgccccggttgcgtgtctggacgatgagaccaatcagtgcgaacgttattatgattgtccgacaatttttgtatgggaaggactggataaagttgtgagggattatctgggcagtgtgacgatacaggatattttggaccgtgccgcttcaaaaggcggaaatgattttgtaatatagatagattcagcaggcttcccggaatttcgggaagcctttcaattatgggtcgtgaccctgttgagcacgcaaagcgtgcgaaatagaaaccacccgctatgcgggtgcgcggtgatagttatacaaaaaaatcacctttccgttataatgaggttgttcaagccaatatataacgaaaggaaaggtgattttaatggccaataaggcaaacagtttatcacataccaaatggatgtgtaagtaccacatagtatttacaccaaagtaccggagaaaaatcatatacaaccagtacaaagagagtatcagagatattctgaaacagctatgctcgtacaaaggcgtagaaatattggaagggcatctgatgccagaccatgtgcatatgctcgtaagtattccgcccaagctgagtgtatcacaatttatgggatatctcaaagggaaaagcgcgctaatgatttttgataagcatgcaaatttaaaatataaatttgggaatcgacatttctgggcagaaggatattatgtaagcacggtaggattaaatgaggcaaccataaaaaaatatattcaagagcaagaaagtcatgatatagcaaaagataagttaagtgtaaaggaatatgaggacccttttaagggtggcaggtaatacaaaagccctttcaagggcagcgacgagtcaagggcgttaaggcttgaacaaagtgaaagccagcgtctttaggcgctggccggtaacagaggcttatagcctcagaacaagccgcccgttttacgggcggtcatgacttgacgttattgcagaatttaactttttgaaaaagccttttgaggcggaatgcccgttttctgtctccagaggatgcgtataaggtacaggaaaaataagactccccatgagcctgcttccgcataggcgatgatcatgtttccacaaagtcccgcaaaagcatatgaaaatataatacgggagaccagtgcggcaatccccgatatactggagaagagaacgtctccgattccttctgtataaccccggatggacatggcgatgccgtaaaccacataaaacgccgcaattctttggaagaaattttttccgatctccgccgattccggacttattccaaacatggaaattaaatatcccccggttcccagtacaacattcacgacagacgaacagaggacagaaccaaaagaagcgcggctgtttccaatgccgcggagtgctgaagtgtagacgttatatacggcaagaaacggtatgccgatcaatataatctgaagataattttttgccatatgaatggtttccggtgtcgtattcatcgtgcgaagcaatggataggcgcccggaatgcccgctgccgggacaagcaaaaaagcacagcccagaacaacagtgaatacggatagagtttttgagatttgatccttttttccggcgccgaatttctgggcaaataaaatggaaaggccgagagtaaaccctgttatggcagtgaggaacaggttaatgattgtagttgtagagccgatggcggccagagcattttctccggccacatttccgacaataaatgcatccgcccagttgtagagctgctgaaggatactgcttaaaataagtggtatacagaatttgatcaatctaattgcagttttttctgttcatttctccataaaataaaaaacgtatgcaagaatcagccttgcatacggtaggtgctcacccggtaacaatatataatatactaaataaatgaatctttttcaagacaggtgaaatcttattttgttgaaaaaagtattgacataaaaaaggtattgcatataattaaaacatactaaacgcgtaggaaatataggaatataaaaaggagaaaaagtatggcaggaatctatcaaaatgtgacagagttaattggaaataccccgttggtccgtttgaaccgtctggaaaaggaatatggagcagatgcagagatcattgcgaaactggaatattttaatccggcaggaagcgtcaaagaccgtgtggcggcacagatgatcgaagacgcggaggcagcagggaagctgaaagaagggtccgtcatcattgagcctacatccgggaatacaggaatcggactggcggcgatcgcggcatccagagggtaccgcatcattcttacgatgccggagactatgagcgtagaacgccggaatctgctgaaggcgtacggagcggaagtcgtactgacagacggtacgaaaggaatgaacggcgccattgccaaggccgaagagctggcaaaagaattaaaagacagctttattcccggacagtttgtcaatacatccaatccaaagcgccataagaagaccaccggacctgagatctggaatgatacggaaggaaaagtcgatatttttgtatcagggattggaaccggaggtacgataaccggaaccggagaatatctgaaagaaaaaaatccggatattaagatcgtggcagtggagccgagcagttctcctgtactttcaaaagggcagagcggtcctcataagattcagggaatcggggcaggctttgttccggatgtactgaacacaaagatctatgacgagatcattgctgttgatgatgcggatgccttcgagcttggaagagccatcgccagaaaagaagggattttagtggggatttcttcaggggccgccctctgggctgccattcagcttgcaaaacgtccggggaataagggtaagaagattgttgccctgcttccggacacaggagacagatacctttcaacaccgatgttttcataataaacttacggatgggcctgatatgtgcttttataagtacatatcaggttttttctatgagtatgcgcggcggaagcggggaaataatatagaaggagaaaagaagctaacatgaagtggactagactattttctttgtgttacaatgatgataattgtttaaaaaaggagaatgtccattatggaaaaaaaattaatgctgatcgacggccacagcatcttaaaccgggctttttatgcgcttccggatatgaccaacagtaagggtctgcataccaatgcgatccttggatttttaaatatcatgtttaaatttttggatgaggagaagccgacccattttgcggtggctttcgacctgagtgcgcctaccttccgccatgaaatgttcaaggagtataaaggcaccagaaaacctatgcccgaagaattaagagaacaggtacccgtgattaaagaagttttaaaagccatggatataccgctgatgatggaagaaggctatgaggcggatgaccttctcgggacgatgtctgtgatcggggaacaagagggctatcaggtgcggatcatttccggagacagggatcttctgcagctggccacagaaaatgtgcagatccgcattccaaagactaagggcgggggaaatgtagtagaagactactttgccgaggacgtcatggaaacttacggagtgacgccgaaagaattcatcgacatgaaggccctgatgggagatgcatccgacaatattcccggaattcccggaatcggagaaaagactgcggctaagatcatcaaggagtttaagagtatagaaaatgcctatgagcacattgaggaagtgatgccgaagcgggctaaaaataagctggaggaattttatgaccagggagtgctcagcaaagaactggctgccattaagctggactgcccgatcgaactttcttttgacgatgccaagttaaatgatatttttacaggagaggcttatcagcttttaaaacagctggaatttaagtcagtcttaaagcggtttgacggagaacacggggaagaattttccgtgaacctcaaaaaggtttctgagttggatgaggccgatcggattttttctaaagcgaaaaaatgtaaggcggcagggctggcagtctatcatgaacaggaatatacttcccttgggctgtgtatagaagggacggatacattcctgtttcagacagagggctttctgaccagagattatctgataggacaggccggagagctttaccgcactgttccaagagtcagcatgatgaatgtaaaggaattcctggatgaattgtctttgagcgaagatgacaagagcatctttgacgcggctctggcggcttatctcttaaatccgttaaagagcacctatgaatacgatgatatttccagagactatctgggtattatgctgccttccaaaaaagaactgctggacaagaagaaaagtatttttgaagagggaaaactgctgccggaaggagagcagatcatcggctatgaggcctatgtggcatgcgcgtgcatcgggcctttaagaaaaaaacttatggaaaccgggatgctttctctgtatgaggagatagagatcccgactatggtggccctccacgatatggaagtcaggggcatccatgtggaccggaaagcattaaaggaatatggggatcagctgatcgggcgcattgaggagcttagggaactgatctataaagaggccggggaggaattcaatatcaattctccgaaacagctgggtgtcgtcctgtttgagcatatgaagctggagggcggaaagaagacaaagacaggctattccaccagtgtggatgtgctggaaaagatcgagcacttatatccgattatttcctacattcttgagtacagacagctcaccaagctgaaatctacgtatgcggacgggctggccaactatatcagcgatgacgaaagaatccacggaaaattcaaccagacgatcacagccaccggaaggatcagcagcacggagcccaacctgcagaatattcctgccagagtagaacttggacgggccatccggaaggtgtttctgccggaggaaggatatacgttcgtggacgcagattattcccagatcgaattgagggtgctggcccatctttccggagataaaaatctgatccacgcctatgagctggaacaggatatccatgccaggactgcttccgaagtgttcggcgtgccgatcggccaggtgagcagcattcagaggcgggatgccaaggcggtaaacttcgggattgtctatggactcagcgcttttggcctgagtcaggatttaaagatcacgaggaagcaggcgcaggaatatatcgacaaatattttgagacttacccaaaggttaaagaatacctgaacagggaagtggaaaaaggaaaaaaagaaggttttgtgaccacaatgtttcagagaatccggcctataccggagttaaagtccagcaactttatgcagagaaacttcggagaaagggttgccatgaactcgccgatccagggatctgcggctgatattataaagatcgcaatgatccgggtcaatatggaactgaagaaaagaaaattaaaatccaggctgatcctgcagatccacgatgaactgctcatcgaagcccatgacagcgaagtggaagaagttaaagaaatactcaccagagaaatgatgagcgctgcaaagctttctgtgccgctgagcattgacattcacactggaaacagctggtatgaggcaaaataaatgaagaaagtcattggaatcaccggaggtgtagggtccggaaagagtgaggtattgaatattttaaggaaagaatacggggccggtctcatcgaggcggaccgggtggcacatgaactcatggagccgggggcggaaagttatgaggctgttgtgaaggaattcggaaatagtattttaactgacgagggaacgatcgaccgtgccgctttgggtgccatcgtgttcaaggacaaagaaaaactcggagttctgaacagccttacccatccaaatgtggagagagagatcctgcaccggatggacagcatggagagtgatccggatatccggctgatcgtctacgaggcagccctgctcacaggggcagaatttgaacagagatttgatcagctctggtatgtgtttgccagagaagatctgaggtttcagagactgaaaaagggaaggggctactcagatgagaaaacggcctccatgataaagagccagccgggagaggagagcttccgcaaggcagcgacgcatatcattgacaattccggaagccttaatgagacaaaacggcagatcgcagagatattgggagcagaaatttaaaagttctgctgtatgaatttttcaaatcatgcgttctcggcagggatatattcgataaatacttttccgcacacattaagctttctgaacaccagcccgtccggaaaacgttcctgcatccaggcctttttggaagatacacaggtttcacctttcttgtcagtgatagcacagcagatatgttcctggccgatattgttttcgtctacagcgattatttttaattcatccataataaaacttctttccggatatttctattataatagaaaaaacctgacagcactgtgtcaggttttttgttatttatcgtaagatggaagaaagcagcttctttgaaattgtaaattcaggggcacccatatatcccggagcaacctcatatttgtcaaatacgatcaccagatctccggatgacgtcaggtaaaaattctgtgaggcagaaatttttttgaattcgtccaccgggacatcagtttttttcgaaacaggctgccaagtttcatgatcttacctgcctttttattgatgttataaatgcggctgtaggaatgagagcttgcttctgaagtctcggttcggatccggatggaaaggaaggaatcattgttcagaagaacttcataatctgttgtgataaatccaggttttcagataccggggctttaccgtctgacatttggtgatagctttatatgcgctttcctgaacgatatccatggcatcactttcattatggacataagtataagccatacggtacaggctttcatattcatcgagaatgataccggctgtcagatcttccatctcctgcatctttgtcatgaatgaaacatccttgttttgtagctacaaaagttagacgcggcagggagaaaaatagtttcaaatccattataacgcaaagagtgataaaaaatttttgcaggatgttgacttgaaaatgctatacattttttattaccttatgatataatggcagatagattcgccgcacgtgtttatgcggacgaagatgaattgaggtagaagaatggaattaacaagtattgcaagcagcagtgaaggcaactctatattcgtaggttcaaaggaaaccaagcttctggtagactgcggcatcagtgccaagaggattgaaaagtctctggacgaactggataccaaggcgtctgagctttccgggatactgatcacccacgagcactccgaccacatcaaagggctgggagtgatgctgagaagatatggacttccggtcttcgccacggcaaagaccattgatgcggttttggacagcaggtacatcggaaaggtagacaaggacttgtttcatccgatcgaggcggatcacccgtttcagcttgacgatataacagtggaggcatcacatgtctggcacgatgcggcagacccggtatgctattccttctattcagaagggttcaaggcaagcattgccacggaccttggagactacgatgaatatctggtggaaaagatcagagattcccatatcctgtttgtagaggcaaaccacgatgtgaatatgctccaggtgggaagttatccgtattatctgaaaaggcgtatactgggggatcacggacatctgtccaatgagcggtgtgcccagcttatagaagatactgtgacggagaagacaaagaaggtttatctgggacatttaagcaaggagaacaactttgcagagctggcctatgagaccgtaaaggtggcgcttacaaagccggatttcctgatggaggtggcaaagagagacagcatttcatccatcacaaaagtcagttaagatacatatttttaggaggatttaaaatggataagacagtaattacagtggtagggaaagacaatgttggaattatcgcaaaggtctgcacctatctggccaacaatcatgtgaatattctggatatctcccagaccatcacagggggatttttcaacatgatgatggttgtggattcttccgaggcgacaaaagatatcacaatattctcagaagaactcaaacagatcggagaagagttaggcgttgtcattcaggcacagaacgaaaagatttttaatgtaatgcacaggatttaacgggggtctgaaatgataaatattaatgaagtaatcgaaacaaataagatgatctcagagatgaatctggacgtcagaaccatcaccatcgggatcagcctgctggactgtgtcggttccacgctctctgaggtaaaagaaaatatttatgcgaaaattaccacggtggcgaaagatcttgtgaaaaccgggaaggatattgaaaaggagtttggaattccaatcgtaaacaaaaggatttccatcactccgatcgcattggtggcggggaatgtctgtaaaacttcggatgatttcgtagagcttgcaaaggtgcttgacaaggcggcaaagcaggtgggagtcaatttcctcggaggatattccgcactggtgagcaaaggcatgacgaaagcggatgaactgctgatccgttctataccgaaagccatggcggaaacagattttgtctgctcttctgtcaatgttggaagtacaaagacaggcatcaacatggacgccgtaaagctcatcggggagatgatcaaagagactgccgaactgacaaaagacaatgactgtttaggatgcggaaagtttgtcgtattctgcaacgctccggatgacaatccctttatggcaggcgccttccacggcgtgaccgagacagattctgtcatcaatgtgggagtcagcggacccggtgttgtgaaacgtgccatcgaactggtacacggggagaattttgaagttctctgtgagaccatcaagaagactgcgtttaagatcacacgtgtgggacagctggttgccaaggaagcatccaaacgccttggaatcccgttcggcatcatcgacctttccctcgcgccgaccccggcagtgggcgacagcgttggagagatcttagaggagatcggccttgagtacacaggtgcaccgggaaccacggcggctcttgccatgctgaatgaccaggtaaagaagggcggcgtcatggcatcttcttacgtgggaggtttaagcggagcatttattccggtcagcgaggaccagaggatgatcgatgcggtcaacgcaggcgccctgactctggaaaaattagaggctatgacctgtgtctgctccgtgggtcttgacatgatcgcaatcccaggaaagacaaaggcggcgacaatcgcgggactcatcgccgatgagatggctctcggaatgatcaaccagaagactaccgcagtccggattatcccggccatcggaaaagatgtgggagaccaggtggaattcggaggtcttttgggatacgctccggtcatgccagtcaatgaattttcatgtgatgattttattaaccgcggcggaagaattcctgcgccaatccacagttttaaaaattagaggtgaagacttttggggtattagatcatttagaaccaaaaaaagtatttgaatattttgagatcctgacaacgattcctcatggctcttacaactgtaaggccgtgagtgatttctgcgtggactttgccaaaaagagaggcctttttgtgatacaggacgaccactataatgtgatcatcaaaaaggaggcctctccttcttgtgcccataagccggtcctgatccttcaggggcatctggatatggtgtgccagaaggaccctgacagtccggtggattttgcaaaagacgcgcttgaacttcagaccgacggagattttgtctctgcaaaaggaacgacgctgggaggagatgacggtattgcggtggcttactgcctggcgctcctggacgatgattcaatgaaacatccacctctggaagtggtgttcactacagaagaagaggtgggcatggagggagccacggcccttgacacctcggttcttgaaggcaggtatcttctgaatatcgattcggaggaagaaggaattctgcttgcgggatgtgcagggggaacgacagtcaaggtctcccttcctcttaaatatgagcagataacgggcagaatgtgcacggtttccataaccggcctcctgggaggacactcgggaaccgagatcgataaaaaccgggggaatgcccatatcctgatgggacggctgctctgctgcgtaaaggggattcatataagccgaatctatggggcttcggagcagaaagacaatgccattcccaacgagtgttatgcggaattgatctgtgaggacagagaagcgatagaagaggcggcggcaaagctgcttcagagttttaaagagcagtttcagggtacagatgacggcatggcagtgagactggaattttctgaaatggaaaaaagggactgcctgactcaggatgcgcaggatgcagtgctttatttccttaaccatacgccaaacggcatttacacgatgagccgggatatcgagggtctggtggaaagttcattaaacctggggattcttaagatggacggagaagaaatctcattttctttcggtgtgcgcagttcggcgcctttttataaagaggagctggcaggccgccttgagtctctggcccggaagcttaacggcagttatgagcgggtcaacgattaccctgcatgggaatataagaaggattcggttttaagagacgtatttttgaaggcttaccggcagatgtacggaaaggaaatgaaagtggagatgatccacgcaggactggagtgcggcatttttgcatccagaatcgagggactggatatcgtgtctttcggaccggatatctttgatattcacacgaccggtgagaggctttctgttccttccgttaaaaggacatgggaactgctgttaaagatcatcgaagagtttccgtaaaagccagaatctattacacggctgaaattgaaaatgaacaatttagataaaggagtagaccaatgagtgaaaatgtatacgatattttgcaggaaagaggctttatcgctcagacgacccacgaggagctgcgcgatctgcttggaaaggaaaaggtaacgttctatatcgggtttgacgctaccgcagacagccttaccgcagggcatttccttacggtcatggccatgatgcatatgcagagagcagggcacagaccgattgcccttttagggggcggcacgactatgatcggtgacccttccggcaagtctgacatgcgaaatatcatgacaaaagaaaccattgaacacaatgccatgcgatttaaggagcagctgtcccggtttatctcgtttgacaacgacaaggcaatccttgaaaataatgcagactggcttttggacttaaactatgtagattttttaagagagatcggagtacatttttctgtcaacaaaatgctgactgccgagtgctataaacagcgtatggagaaaggacttacattttttgaattcaactatatgctcatgcaggcatatgatttcctggagctgaaccgcagatatggatgtaccctggaaatgggtggaaatgaccagtggagcaatattcttgcgggcgcggatctgatccgccgcaaggagcagaaaaatgcgtttgggctgacgcttaccctgcttaccagaagcgacggtgtgaagatgggcaaaacgatggcgggagccgtctggctggaccctgaaaagacttctccgtatgaattttatcagtactggagaaacatcgaagatgtgaaagtagaagagtgtctcggactcttaaccttccttccgatggaagaggtgagaaggctgggagcgcttcaggatgccgagatcaataaagcaaaagaagtgctggcatatgaagtgacgaagatcgtccacggcgaggaagaggcgaagaaggcacaggccggagcaaaagccttgtttgtgcagggtgcggccagtgaggatgcgccggtgcatgagtattccaaggcacggcttgaagaaggactcgatatactgactctgctggtagatacgaaactttgctctacaagatctgatgccagaaggaccgtgatccagggcggcgtatccgtcaacggggagaaagtgacggactttaaacaggtgtttacttcggcagattttgatgacaaagaacgtctgctcctgaaaaagggaaagaaaaagttctgtcaggttaaagaaggaaaataacaggaagatttggaacaggacatgcagctgtcctgttccttttgctattctaagtatgatgacaggaggtgaagatatggcttcaagtgttgaatttgtagaatatgtatgcggtcaggcagagggtgccggagatgtctcttacagaaaaatgttcggagaatacggtatttatctggacgggaaatttataggtgtcatctgtgataatcaattttttgtcaagatcacgaaagccggggaagagattctgcctgagtgtccgaaagaaccgccctatgacggggcaaaaccttattttctcatcgaagatccggaagatcgggatttgcttcaccgttttcttcgggcttcatttgaggaacttccggagcccaaaccaaagaaaaaataatctgcaaacagccgcttccaacgaataagaggaagcggctgtttgagggttaatggaaatttttttggatttcattgagagctttttgggtataagggtctctctggtcgatgtgctgaatgacggacctgattttctgggcatctctggaaccggctgttttagaaagggagaggacaaacagcagcagaatgatagaaaaaatcatgcgcagcttcagaaaagaccagtagctggcgctctcttccggttctgtgtgaaacggatcggaatgggaggcgtatttttgatttaatttcagtttttcctgctccatgcgaagccttgttaaatctgtcatctcatcatctcctttcttcattatatgaggcatgtatttttctatgacacaaaaagttcagatattttatagtttctttatgttttccggcaaatgaaaatgctataatgttacctatgacattttccagtgtttcatgattatatttgaacgtaaagaaaggtgagttgatgagagataagattcagagttttttaagagggcgttacggtacagattctctttcgaaatttttgctgatcgtggctttggcggggatgtttcttcctatatttataaagaaagcgtttcttttatattatttaggggttgttttgctgatttattcctatttccggattttttccaggaacattgccaaaagatcggctgaaaatgcggcatttctcaggaggaccagcaagattaccggttttttcaggaggaagaaacttcattttgaacagcgcaaaacgcacaagtttttccggtgtccgggctgcggtcaggatatcagggtaccgaagggcaaggggaatatcgtgatcacctgtccgaaatgccggaaagaattccaggcgagatcgtaaaaggaggcttgcatgtttggatatttgactgtcaataagcctgagatgaagatcaaagattatgagcggtaccgtgcttattactgcgggctgtgccggcggctttacaagcattacggaaaaaaaggtcagctgacgctgagctttgacatgacgtttcttgccattttattaaacgggctttatgagccgaagcttcactccggtaagcacttctgcggactccacccaacgaaaaggcagaaggttatgtgcaatcagttgagcgactatgcggcggatatgggaatgcttcttacttattataatctgctggatgactggcaggacgataagaagcttaaaagccttctgctggcagatggcatcaggaaaccatgtatggagatcgcccggagatatccgagacagagccgggctgtcagagattatataaagaagctttctgtctgtgaaggggagaacacggatcagctggatcgtgtggcaggcctcacgggaaagatgctcggagagatttttgtcttcagggaggatgagtggtctgatgatctgagaacgatgggattctttcttggaaagttcatctatctgatggatgcctacgaagatttatccgatgatctgaagaacgaacggtacaatccatggagtttttatgcgaaaagcgaagagtttgatcagagagcagagacggtcctgaccatgatgatgacggagtgtgccgctgtgtttgaacgcctgccgatcttaaaggatattgaaattctcaggaatatcatttattctggagcatggacgaaatttgagatcgcaaagaacaaaagaaaaggcagtgaggaagagtgagatggatgaagcatatacaatcttaggcgtatcccaggatgcgactgatgaggaaataaaaaaagcataccggaggctgagcaagaaatatcatccggatgctaacttaaaccagccggaatatgcagagcggaagtttaaagaagtccaggaggcctacaaaaaggttatggactttagaaagtacggcgcatccggcggaaacccatatggaaatccatatcagggagagcagtcctcctatgggggatacggcaatgccggaaccggttcggcagaaatgacggccgcctataattacctgcgggcaggacattaccgggaggcgcttcaggtgctcggaggtatctcagagagaaatgcacagtggttttatttcagtgctgtggcaaacatgggcatcggcaacaatgtaaccgcgctggagcatgcgcagacggccgtacagatggacccttccaacatggaataccggatgctcctccagcagatgcagcagagcggaaactggtatcagaatatggggtccgggtacggaagaagcagtatgggaagcagctgctgcatgcagctttgtatgctgaatatgctcatcaactgctgctgcaggccttattaacaatggaacataaacaggaggacttatgggtaagatcatagggattgatttagggacgaccaacagctgtattgccgtgatggaaggcggaaaagccgttgtcatacataatgcggaaggttcaaggacaacgccgtcggtcatggccatgaccaaaaatggggagagactgattggagatgcggccaaaaggcagtctgcggcaaacccggagcggacagtgtcatccattaaacggcatatgggaacggattacagggtaaaagtcgacggaaagaattatctcccacaggagatttccgcccagatcctgatgaaattaaaggaagatgccaagagctatctgggaacggaagtgacagaggcagtgatcaccgtgcctgcatattttaatgacgcccagagacaggccaccaaggatgcgggaaggatcgcaggtcttgatgtaaagcgtatcataaacgaacctactgcagcagcactggcctatgggctggacaacggaacggagcaaaaaatcatagtctatgacctgggaggcggtactttcgatgtatctgtcattcagatcgaagacggtgtgattgaggtgctggcaacttcaggaaacaaccacctgggaggtgatgattttgacgaggcagtggcagcgtatctggttgaaacttttaaaaagacagatggaattgatttgaaaaaagatgtccaggcaatgcagcggatcagggaagcggcagagaaagccaagatcgaactttccagcatgtctgagacaaatatcaacctgccgttcatcgtcgtggaacggggtgagacacaccacatggatatccagcttacgaggacaaagtttgatgagctgacttacagccttgtatcaaaaaccgaagaaccggtgagaaacgcgctgaaggatgcgggactgtctgcaggagagatcgacagggtgctgatggtcggagggtctacgaggatcccggcggtacagcggaaggtggcagagatcaccggaaagcgtccggaccagtccttaaatcccgacgagtgtgtcgcactgggagctgccatccagggagggaaacttgcaggagaggccggaaccaatgaagtgctgctcatggatgtaacaccgctttccttatccatcgagacgatgggaggcatggctaccaggatcatagagcgcaattcgacaattcctacccgtcacagccagatttttactacaggcgccaatttccagacagccgtggatatcaaggttctccagggagaacgtatgatggccaatgaaaacaaggtcatcggcaatttccggctcaaggggatcaaacgggctgtgagaggggtgcctcagatcgaagtgaccttcgatattgatgtcaacggtatcttaaaggtatcggcaaaagacctggggaccggaaaggaacagagcgttgtaatcacttcaagttccaatatgtccgaggaagaaatcaaacaggcgatccgtaatgcaaaggaaaatgcagcgttcgataaggaacacaaagaagcggttcagtcctaccatgaggcggaagagacgcttgtcagagcggagcagtatcttgcagagcacaagaaagagatcgaaaaagaaaagaagaaagccatcaaagatgcagcagcaaatttaaagaaagcactcaaacatgtgaagcttgaaaagattacgagggaacaggccggtgaactgaatgcagcgaaagaagaacttttttcggttttgccgtaagattaaaataatatgataaagattggatatagtaggaacaatgttcagaaaaacaggttcctactatttttttaacgaaaaaatataataggaggggttgacaatgatttttaaaagtgataacttatgttatagatattagcactcgtttgagttgagtgctaataatgaaaggaaagataccatggatttaaatgatcgtaaaagactaatactaaaagcgattatagcaaattatctggagaccggggaacccgttggttccaggacgatttccaagatggagggactgaacttaagttccgctacgatccgcaatgagatggcggatcttgaggatctgggtttcattctgcagccgcacacgtcggccgggcggataccttcggatctgggatatcgtttttatgtggaccagctgatgcaggacagagagtcggacgaagaagaacggctggagcttgtcaagaaagttgacaagatggaagtgatgctgaagcaggttgccaatgtcctggcatccagtacgaattatgcgacgatggtatctgcccctcagtacaaaaatacaaagctcaagtttgtgcagctttcccaggtggatgagtacagtctgctggcggtcatcgtggcagacggcaatgtcgtaaagaaccagatcatcgacgtggaaaaaccactggcaaatgacgaagtcctgaaactgaacgtattattaaactcctttctccaggggctgaccctgaaggaaatcaacctggagctgatccagacgatgaaggatcaggccggaatccacagccagatcctggaaaggattctggaggagatcgcagtcgttatccacaacgcggatcagctggagatctatacgggaggtgcttccaatatcttgaagtatcctgagcttggctcgccggagacagctactgagctgttggatgctttagtggaaaagaaggcgctgaacaagctggtgggcgacacattggaaagtgatgaccaccacggaatccaggtttatatcggagatgaagctccggtcaagaacatgagcgactgcagcatcgtgacagccacttatgaactggaggaaggcggaaccggaacgatcgggatcattggtccgaaacggatggattacaagagggttgtgaagacactccagaatctgacggatgagatcaacgatctgttcaagaaaaaaacataggagggaaggtgcattatggaagaagagaaaaaagttcaggaagaggaaatgaaagaaaatacagtgacagaagagaaagaaacagaaaaagcaaaagatacaaagaaggcagacaagaaagcatcgaaaaagcagaaggcagacgatctggtaaaagagaaagaccagcagatcgaagagctgaccgataagtatcagcgccttatggcagagtttgaaaatgtcagaaagaggacggccaaagagtttgttcagagatatgacatgggagccatgggagttttagaaaaacttcttccggtcgttgataattttgagcgggggctttcagccgtggcggaagaagaaaaagattctccgtttgttcagggcatcgaacagatttataagcagcttatgggaactctcgatgaattgggagtgaaggccatggatgccgagggaaaagagtttgacgccaatctccacaatgcggtgatgcacgtggaagacgaagaagccggagaaaatgttgtggtcgaagagcttcaaaaaggatatatgtataaagaaagcgtacttcggcacagtatggtaaaagtagcgaactaaatgtaagacacttgaggaaatcaagcgaaagcattggaaatatagaaagatttattttaggaggaaatttatcatgggtaaaattattggtattgacttaggaacaacaaacagctgtgtagcagttatggaaggcggaaaaccaaccgttatcacaaatgcagaaggtgtgaggacaacaccgtctgtcgtggcattcacaaagacagatgagcgtatcgtcggagaacctgcaaaacgccaggcagtgacaaacgcagagaagacaatttcttctatcaaacgccacatgggaacagattacaaagtaaagattgatgacaagaactatacaccgcaggaaatttcagcaatggtacttcagaagctgaaagcggatgcagaaaactatcttggagaaaaagtaacagaagctgtcatcacagtaccggcttactttaacgatgctcagagacaggcaacaaaagatgcaggtaagattgcaggactcgatgtaaaacgtatcattaacgagcctaccgcagcggctttatcttatggactggacaatgaaaatgaacagaagatcatggtttatgacctcggaggaggtaccttcgatgtatccatcattgagatcggagacggcgtcatcgaagttctctcaacagccggtgacaataaactggggggagatgatttcgacaatgtgatcacaaactacatgttagacgagttcaaaaaacaggaaggtgttgacttatccggagataagatggcaatgcagagactgaaagaagctgccgagaaagcgaaaaaagaactttcttctgcaacaaccacaaacatcaatcttccgtttatcacagcgacaaacgaaggaccgaaacattttgatatgaatcttacaagagcgaagtttgatgagctgacattgtccctcgtagagagaacagcaactcctgtcaacacagcattaaaagacgcaggaatcgcagcttccgaactgagcaaggttctccttgtaggaggttccacaagaatccctgctgtacaggataaagtaaaacagctcacaggcaaagagccgtttaagggaatcaacccggatgaatgtgttgccatcggtgcttctattcagggaggtaaattagccggagacgcaggtgcaggcgacatccttcttctggacgtaacaccattgtctttatctatcgagactatgggaggcgtggcaaccagattgatcgagagaaatacaacgatcccgacaaagaagagccagatcttctctacagcagaagataatcagacagccgtagacatcaacgtcgtacagggtgagcgccagtttgcaaaagataacaaatccctgggaagattccgtctggacggcatcgcacctgcgagaagaggtgtgcctcagatcgaagtaacctttgatatcgatgccaacggtatcgtaaaagtatccgcaaaagacctcggaaccggtgcagaacagcacatcaccatcacaggcggatccaatatgtctgatgaagatatcgaaaaggcagtaaaagaagcagcagaatttgaaaaccaggataagaagagaaaagaagcgatcgatactagaaacgaagctgattctatggtattccagacagaaaaagccctggaagaagcaggtgacaaagtagatgcaacagagaaagtcaaagttgaggaagacctgaaagcattgaaagacttgttagagcagacaaaagacgctgaacttacagaagctcaggtagaagatattaagaataaaaaagatcagctcatgaacagtgcacagggattattcaccaagatgtatgaagctgctgcagccaatgcccagggagctcaggatactgcaggagacactgccggagcagcaggtgcagcagacgatgtcgtagatggagattacaaagaagtataagagaaaaagaaggtagacgattatggcagataaacgagattactatgaggtgctgggggtatcccgcagtgcttcagaatcagaaataaagaaagcctaccgtaaacttgcgaaacagtatcatccagatacgaacccgggagataaagtagccgaggcaaagtttaaagaagcttccgaggcctatgaagttttaagtgatcctgaaaagaaagcgcagtatgaccagtttggtcatgctgcctttgagcagggcggacccggaggattcaacggaggagggtttggcggttttgatttcggcggggatatgggagatattttcggagatatcttcggcggtatgttcggcggcggaggcagaagccagcgtgcggccaatactccgactcagggtgcccatgtgcgtgcaaggattcatgtaacctttgaggaggcagtttttggaacaacgaagaagctggaaatttctctgaaagaggagtgtgcttcctgtcatggaagcggtgccaaagccggcacccatccggagacatgtccgaagtgcggcggtaaaggccaggtagtatatacccagcagtctatgttcggcacggtgagaaatgtccagacatgtccggactgtcacggaaccggccaggtcatcaaggaaaaatgtccggattgccacggaagcggctatgtgagccagagaaagacgatcgaggtcacagtgccggccggcatcaacaacggacagagcatcagaatccgcggaaaaggggagcccggaacaaacggaggaccgaggggagatctcctcgtggttgtttccgtggaccggcatccgaaattccagagacaggaatacgatattatttccacggagccgatttcctttacccaggcagctctgggcgcaaccatcaagatcaatacggtagacggtccttatgactatacgatcaaggcaggaacccagacggacacccgtgtgcgtctgaaaggaaaaggtgttccgactctccggaacaagaatgtccggggcgaccactatgtgacccttgttgtacaggtgccggaacatctgaacgaagagcagaagaatgcccttaaaaagttccaggaatccatgggggaagtgccgaagaaagaagaacataaaggatttttcgggaaacataaaaaataaaaaacaggattatgatgttcttatattcatcataatcctgttttatcatgcccataatcagcagacagtggataaaggcagaaggagtattagcagccaccagcagttaaaagacgttccagactatgtgcaattccatcttcgttatttgtcagagtcacctcatcagcggcctctttcagagcatcgcaggcatttcccatggcaacgccccggccggaaaatttgatcatctccaggtcgttttctgcatccccaaaggagatgacttcctcaggggagatatgaagcagttcacatgtccggcgcagtccctcagccttattgagtccctttggcatggcttctatgtaaaaaggcgcagttcttacgaagaccagagcatcttcaaagggcttgctgacctgtggaagcatatcccaaagttcttcgggccgtacagacattaaaattttcaccaggtcaaaattgagacagtctgtcaatgatgggacttctgtacattccatttgattgtttcggcattcgtgccggaccatatatccgttctcatcggttacataaaaacgttctccgtcgtctatgatcggggtgaccggataatgttccaaatgttttaaaatttctatggccagaccgcggggaaaaatctgctggtgaagaatctctttatcctcggcccgcagtattttaccgccgttataggcgatcagtattccatggtgtttttccagctccagtgttttcatatctttataaagtcccggaaccgggcgtgcggagcagagagctatgataagtccctgctgctgtgctttaaggagggcatcccgggttttcggggtgattgtcttatcatcggtgtttaaggtaccgtctaaatccagggcaattaatttatatttcatctgatgcagaatcctttctgtatataaaaagttatcaaatgtacatgttgataccaaggtcaaaaggtcatgcgtttcatgcttgcatgaaaaagcaggactttgggacccgcaaaacatgagaaagtagcccgattagggcggatttcgaatgtttctaggattgtggaagcacaaaatgcgaaacaatccgtaggtatccaggggtcaaaatatattttgaccctaacatcacatgtttagtatagcattaagaaagtatgtctgcatatataaataataaattattatcatatgatgataaactacaattattcataattacagtgcggcagtataatgagagtaatgaaacctgaaaatttatagacagagcaccggaataagaaatggagggacaagaagatggaatattcacttgacaatgtcttacacggatatcatatgctatgatgaggtgaaaaaaatttgaagagattgcctggaaagaaaaatccgactattgagtataaaccgggcagaaatccggcaaaagtttacgggcaaacatctggtggtcatctcctccgatgatgagatttacagggctggagctgttaaactgcggtgcggacccggagaaattgtggatgagttttgagagaaagatgtcctgtgccatcggaaagtgcggccactgccgcatcgatgaagtgtatgtctgtcttgacggaccggtattcccttacatgacagccagagatctggtggattaaggaaggagtgtgcagcaatgaatcatgataccaatgtgggcaaagtacggctgaattgtttcagccagtccaaagaacctggggcgacgacaacttccatttcggaacacgccagacctttgatattccgggcattaaatatgaaaatatcccggcagtcaatgcctgcttggagcggtatatcaaagaggtgaacggaactctctgcggggccagcatggatacggtggcccatgagccggagccgtgggagccaaaggcaggctatccgaccatcggagccaggaagatcgaaccgatcatttttccgagccattaccatatcaagatcaatgataaccgacgaagttttaccgggtgatcctgggaggaagaacaggacgccagattccgagagccggaaagatgtttcttaactgggccacggaagaagtgattttgggagtcctgggcaactggcagaaattttctgcctgggtcatggactataagccggagtacctgcacggaggccatctgatcgaccgggccggttataagaagtttaaggaaatcatgctggaaggcgtagaactgaatccggaatgtctggtggctgaggatattttctggagtgagacggaatagccgggtgttgtttaacttctcatgttcacatgttatgatataacaaaaagactgaggagggactgccatgaagctgaaacaaatcatatcgatttttatcatattgttctgtatttttcttatgggaggatgcgccggaaagacagaggtgccagataaaagacaggaaaaagcggcagagaaaacagggaaagatacagtaatctatgtggtcaggcacgggaagactatgctgaatgaagcaaagcgcgcccagggatgggctgatgctccgctaactgacgaaggaataaaggtgacaaaaaagttggcctgtggttttaaaaagagagggatcaagtttgactatacttattccagcgacctgggaagaaaccggcagaccgcaggaattattctgaagggactgggccaacctgaactttccctgagggaacaacaaggtctcagagaagtctgcttcggaacctatgaaggtgagaaattttcaaaaatgatggaggatgtctcaaggaatctgggatgttaagacccggatgcaaaaggcgctcagaaacattgcaaaggatacggagaaaaagggcgggggaaacgtcctggttgtctcccatggaatggcgatcattactatgctctctgatatgacagagcaaaaagtacccggacatcttgaaaattccagcgtcactaaaattatatataaggatgggagatttaatgttcaaagtattggggatacaacctatttggaacagtaaattcagataggcaaaaatagtcgagagtttttcttttgatccatctataatgacaggtataaaggaggtgaaagatatgagggaacagattttggcagtccagcgcatgcaggaattcatagaagaacatttggcggaaaatattactctggccgacttggcgagagtgtcgctgtattctccatggcattcctatcggctgtttacacggtatgcgggaactacaccagctgattatatccggcggctccgtctgtctaaatcagccttaaagctgagagacagtacctgtaaaatagcggacgtggcttttgagatgggatttgacagtgtggatgggtatcagcgtgcgtttcagcgtgaattcggatgcaatccccgtgaatatgccatgaatcctgtaccgttatatctttttaccccgtacggcgtgaaattcagggagattgaaaggagaccaatcatggaaaatttgagaaatgtattcattcaagtgatggagaagccggaacgaaaggtgatcatcaagagaggaaaagaagcctcagactattttgcatactgtgaggaagtaggatgtgacgtatggggacttttattaagtatcaaatctatcaggggagaacctgtctgcctctggctgccgcctgcctaccgggagccggatacatcagaatatgtccagggtgtggaggtatccaaagattatgacggtgaggtaccggaaggatttgatgtgatagaactgccggctgccaggtatttaatgttccagagcgaaccatttgaagaagaaaactactgtcaggccattgaagaagtgtggaatgcgatgaagaaatacgatccgtctgtcattggatgccagtgggatgagagtaacccgaggattcagctggaaccgattgggacaagaggctatatagaactggctgcaattaaataaggaatcatataataagccctggcagttgaccagggctttaaaatgtctatatagattgatggaaagatacttgaattaaaatttgatatttcatcgctgataaaggaggaaaatactttctttataacatcttcccatgcctcatgttcttgatgtacattaaagataagtctttggtatagtctcccaatggaggtgacagagggaagtttatatttacagtgggtaattgtgtcaaagtatccagcagaaatttgataagcctcaatgacttccattgttacttgttcaagtggaaggctatgattgacatccgcatattttagatgatgctttaaaccttctgttccgagtttttccacaactgttttacggagggtattccacaaactgggaacatgcgagacccgctgccgggagagcggcagtactttctactttgggtgttggcattggcgcggcagtggggattgccggaccaaagattatccggaagtttaagttttgtaccgatggatttgatgcggtttttgtactggcagtggctctgacctcgtatgctctggctggaatccttggaggaaatggatttctgtcggtttatctgacaggcatccttatgggaaatgcaaagacgaaaaacaaggccaatgtcgtccgctttttcgataatgtaaccattcttgctcagatagcaacattctttctcataggactgctgtcctatccgtctcagatagcttcatcacttccggcaactcttgtgatcattctgtttctcacactggcagcaaggccggcgatggtttttatattgacggaaagatatctgaaattccgtgaaaagatatttgtctcatttgcaggattaagaggagcgtcgtccatcgtttttgcaatctttgcctcagccggcggagtgtatatgcagagcaatgtgtttcatattgtttttggtctgtcactgatgcagcttcatatctcatccggacaccactgggagaatcagaagcttaaggatgtcaccctgccggagggctctctggctatggtaatccggcgggaggacgacatcatcattccaaagggagatacagtgatgatggccggcgatgatatcgcggtgaatgttccgtcatttgaagccgcaaatgagatttctctcagggaaatcacgattgaggaagatcatccatggagagacaaaaaaattcgaagatttacaaagacgacatactggtgatttaagacgaataggagatagaaaatggagacatatgaaggtgtaatttttgactttaacgggacactgttttttgatgatgataagcatgtgctggcatggggagagatttccagactactgcggggaagagatatcacggatgaagagctgcacacaaagctgaacggaactccgaacatagtaaacattcaatatatgatggatggaaaagcaagtgaggaggaactgaccagatattcccgcatgaaggaagaatattaccggaaattctgcagagaggataaagagcattttcatctggtgccaggagcagagacatatttcgattatttgaaggcgcaaaagattccttttaccattgccagtgcctccatcaaagaaaatatagatttttttatcgaatctttccggctggagcgctggtttgagccgtctgagatcgtctacgatgacgggacttataaaaataaaatcgccatgtttaaaaaggcggcggatcttattggagtggatatggcacgtatccgcatttatgaagattccctgtcagggatcagaagtgcctatgaagcggggtgcagggatatcgcagtgatttgtccaaaggaaaaggaggaagaattaagaaagtaccccggagttacaaaaaccatgcgcgacttcttgttctgagcctgtttctgtgatacactaattaactggtatagtgaaacggataagaagtttaaaggagcagatttcatgggatggaacaggattacgatcagcaccgtgacaggagcggaggatatgctgagttatgaactaacagaacttggggcgtgcggcgtggaagtggaggaccgggtgcctctgacggaagaagagattcgggagatgttcatcgaggtattgccggaccaccaggaaccggatgacggcagggccctgctccactgttactttgatgaatccgaaaatctggaagacgtgaccatcagaattgaggagatgctcaacagggtaaagagtttcatggacatcggagacggcacgatcgaatatggctttacgaaggaagaagactggattaacaactggaaacagtttttcaagccgctgagactggatgatacgatcattatcaagcctacctgggaggagcttcctgatcaaagagagggagatgtggtgatagaaatagatcccggcactgcctttggtacaggttcccatgaaacgaccagactttgcatagcagggctgaaagaggaaatccgtccggataccgttatgctggatgtgggctgcggaagcggcatcctttctgtcattgccctgaaattgggagccgggaaaacggtcatgacagatattgatccgagagccgtaacagcggcagaagaaaatatggaagtgaaccatattgacagggaccagtatgaagtatacggcgggaatgtactggatgatatggactttgcacggtctttgggagagcaccggtatgatctggtagccgccaatatactggcagatgtgatacttccgctgattgagatcgcagatttgttcctgaaggaagacggtgcattcgtaatctccggtattatcgatacgaaggaacaggaagtgctcgataagctggagagatatggttttgaggcggtaaaaacaagaaagctcaaagagtgggtctcagtcacagcgaagaaaaggaaagaataatgtatcgtttttttatagaagaaagccaggtggacggaaacctgatcaggattgcaggggaagacgtcaatcatataaaaaatgtgctcaggatgaaaaagggagagcatgtgctgctctccaaccgccggggactggaatatgagtgtgagctggaagatctggaaggaaaccgcgggatttcggccagaatccttgatatccacggggtggagtcggaactttgtgaaagaatcatcctatttcagggcctgcccaaaggggacaagatggagctggtcattcaaaaggcggtagaacttggagccagtgagatcgtgccggtaaaaatgaagcgctgcgttgtgaagctggatgacaaaaaggcgaaaaagaagctggaacggtggaatgccatagcacttggtgcggcaaaacagtcaaagagaggcgtgatcccggaagtcagccgggtgctcacgtttgaggaagccgtaaaaagagcggaaggtttatctgtgctcctcgtgccgtatgaagcggctgagggcatggaatactcaagaaagctgatcaggaagacaaaaggcaaggattcgatcggtatttttatcggaccggagggaggatttgaaccttcggagatcgaacgcctgaaggaagcgggaggcagggttttaagcctcggcagaagaattttaagaacggaaaccgccggcatggccatgctgtcggttttaatgtttgagttggaggaataacatggtggtatatttagataatgcggcaacgacaaaagtatttccggaagttctgaaggtcatgaatgaggcgatggaagtatcctatggaaatccctctgccaagcatacaaaagggatcgaggcggaaaatattgtgaaaaaggcccggcagatcatcgcagggacgctgaaggcaaaggaaaaagagatcatttttacatccggaggcacggagtccaataattttgcgatccttggaacagcgatggccaacaaaaggcggggaaaacacatcatcaccacgaagattgaacatgcctctgtgtatgaaccgatgttctttttagaaaatgaaggatttgaagtcacctatctgaacgtggatgaaaaagggattgtcgatttaaaacagcttgaagacagtatcagagaggatacgatccttgtctcctgtatgctgatcaacaatgagatcggcgcggtggaacccatagaagagattggaagcatcatagagaagaaaaatccggagacagtcttccacgtagacgcaatccagggatacggaaaagttccggtgataccgaaaaaggcaggaattgatctgatgtccatgagcggccacaaaatccatggtccaaaaggtgtcggctttttgtatgtgaaagagaagacaaaaatacagccgatgatcttaggcggaggacagcagaaaggaatgcgttcgggtaccgaaaatgttccagggattgcgggactttcagaggcctgcgggatcatggcagggcatctgaaagaaaatgcgcagaagatcggagaagtcagagagtatttcagaagccggatcacggagattcccgagattaaagacaattccggtgatgcgccccacgtggcaagcatcagttttaaaaacatcagaagtgaggtgctgctgcacgcacttgaagaccgggaaatctatgtttcttccggatcggcatgttcttccaaccgcccgcatgtaagcggtactctgtcagccatcggactcagccctgagtaccgggacgggacactaaggttcagcttttctgtctataacacaaaggaagaagtggatcaggtcatagcggcgctggaggaattagttccgatgctgaggaaattcgtaagaagataagaaggagaaaagatgaaagtacaagcttttttaataaaatatgccgagatcggcattaaaggaaaaaaccgctacatgtttgaggatgcactggtcagacagatcaagtatgccatgaagccggtgggagaatttaaagtgagaaaagagtccgggcgcgtctttgtggaaggacaggaggattttgactatgaggaagccgtggaagcgttaaagactgtcttcgggatcacgggcatttgtccgatggtgatcgagcatacaaaggatgtggaacatctgacggatgctgcagtacgttacatcgacagccagtatggaaagaaagatttcacctttaaggtcaatgcaagacggggagataaggaatttccgatgaattctatggacatcaactgtctggtgggagaaaagcttttggatgcgtggccggacttaaaggtagatgtgcactgtccggacgtactcgtaaacattgaggttagacagcagatctatatttattctgtggagatccccggaccgggaggcatgccggtgggaacaaacggaaaagccatgctgcttttatcaggggggatcgacagtcctgtggcaggatacatgattgccaaaagaggggtgcgcattgatgcgacttacttccatgcacctccgtatacgagcgagcgggcaaaacagaaggtcgtggatttggcaaagatcgtttcaaagtatgcagggccgatccatcttcatgtggtaaactttacggatatccagcttgctatctacgagaaatgtccgcatgaccagcttacgattatcatgcgccgttatatgatgaagatcgcagaacactttgcaaaggaaaatgacgcactggcgctgatcaccggcgagagtatcggtcaggttgccagccagacaatccataacctggcgatcacaaacgacgtgtgtcatatgcctgtgttccgtccgctgatcggaatggacaaacaggaaatcgtaaatatcgcagagaggattgacacctttgagacttcaatccagccgtttgaggactgctgtacgatctttgtggcaaaacatcctgtgaccaaaggaaacttaaagaaaattgagaaatcagaagaaaatctttctgatgtcatagatgaactgatggaaaaagcgatcgaaactacagaagtgatcgttgtaaaataaagaatgggttactgaggggaagaacagagaaagggttccagcctttgaagaatctcatcccttttttcgggaatctgaaaggccagaagaattggttcatttaagtttaggctgaacaggtccatgacacttgcggcgtccaaaaggtaggaacccaagattatgtaaaagccgccgtcatattctttgataatattgataaagtcgttgaccttttttatggaattcagcattaattgtacttcgcacatgattcatcctccaatgacgatagtgtacaagctaacatttgaattgtcaataacaacgaaaggaaaagaaacactccatgagtttaaataatgtgaaagccgcagtcgtgactttgggatgcaaggtcaatcaatatgaatccgatgctatgtttgacatgctcacggatgcaggggctgagatcgtcagccccaaagagggtgcggatatttatatcgtcaatacatgttctgtgacgaatatagcagagcggaagtccaggcagatgctgcaccgggcaaagaagctgaatccggataccgtggtggccgccgtgggatgctatgcccaggtggggaaggatgaattgaaaaaagatccgctgatcgatctgattattgggaataataaaaagaaagatttgatcccgatcctcgaaaattacctggaaggccaccgccgggacgctgaggttttggatttgtcctcgggaagcgaatacgaagcgctgcatgtgagacatttaaatgaacacacgagagcgtatatcaaggttcaggacggatgcaaccagttctgctcttactgtattattccctatgccagaggaagagtccggagccgggatacgaaagatgtcctctctgagatcagaggccttgcagaaaatggatgcagggaatttgtcatcacagggattcatgtgtgttcctacgggacggatcttgacggggacaaaggactgattgatctgctcgaagaaataggaaagatcgagggagtggatcgaatccgtttaggttctctggaaccggggatcatcacagaagattttgtaaaaaggcttaaaaatatagagcagttctgtccacattttcatctgtcccttcagagcggatgcgatgctaccctgaaacggatgaaccggaaatatacgacggacgagataagagaaaaagcagagatcctgagaaaagcttacgaagatcccgcactgacaacggatatcatcgtaggatttccgggggagaccgaagaagaattcgaggcaacgagaaagtttctggaagaaatcgacctgtatgaaatgcatgttttcaaatattcaaaaagagcaggcaccagggccgccgtcatggaacaccaggtaaatgatcaggaaaaagccagaaggagcgcagtcctgatcgccatgaacgaggaacataaaaatgcgtttgaacgcaggcagatcgggacacgaagaaaagttctgatcgaagaaaaattaagaaacagctccggaaatttctatgtgggacacacaaaagaatacgtcaaagtggcggtggaaagtgaagaacctctggaaaatcagattgtggaagttgaactcaccggtatcagcggtgatggatatgtggcaggaaatgtgtagaaaatccattgctattttttcggatatatattagaataaaaaaaagatacgaaaaaggacgtgagaatatggataagaatcagacacagcatttttccgtggtgaaagatgaactggacgtgcacagaatattagagcatgtctatgaagcactggaggaaaaaggatataacccggtgaaccagatggtaggctacattatgtcaggggatcccacctacattaccagccataagaatgcacgaagcatgatcaataaagtagagagggacgagattatcgaggccctgtttgtaaattatattgatacaaggctgaagtagggattatgagaatacttgggcttgattatgggacaaagacagtgggcgttgccctgagcgatgagctggggatcacagcgcagccgtttgaaaccattacgagaaaagatgaaaataagttaagaaagacttatgcaaggatcgaggagatcgcggccgaatataaggttgaaaagatcgtcctcggatatccgaagaatatgaataatacgatcggagaacgcggaatggcaacggaagctttccgcgatagtttagtgcgcagaaccggactggatgtgattttatgggacgagcgcctttctactgttgcgtccaataaagtattgatggaaagcggcgtccggagggaaaatcggaaaaaggtcattgatcaggttgctgcatcgatgattttacaggggtatctggattctctgtaaagaaaggattgataaaatgaaagacaaagagagcagaattctctttttagatgaccagggccgggagattgaatttatggtgctggaacagacgacactggcagggacaaactacctgctcgttgcggattccgtggataaagacgggacagttttgattatgaaagaaatctcactggaggatgactatgtctcctacgagatcgtagaagatgaagaagagcttgagatcatatccaagatattcaatgaattaatcgaggattttgatttgacagtataaatgcagcaggattttgaggtggtttgatgggctataacgaagaatcttttataaaaattttaaagagcaagggtttaaaagtgacgaatcagagaaaaactgtattaaaggcactttcatcaaaaccggaccagcacctgaccgcggaagaaatctatgaattggttagagtagacattcccgaaatcgggattgcgacaatttatcgtaccatacagttactttgtgaattaggattaattgataaattgaatttagatgatggatatgttcgctatgaaatcggaaaagaagataaaaatgagcaccaccatcatcatttgatatgcgtgaattgcggaaaagttttaaagttcgacgatgatttattagatgaattggaaaaacaggtcgggaaaacgaccggattcatcgtccatgatcatgaattaaagatgtacggatattgtcgtgattgtcaaaataaccggaagtaataaaatggaggaattattttgaaatcagacaacacaagtgtaggtaacaagacagaaggacagcagcaaaagaagcagtcaaaaaacttttggccgaaaaagtacagtcagccgaaaactccggcagtgataccgaatgagtcgaaggaactcgcggtcagggcaaagccgcaaaagaaagagacggcaccgaagaagacggcacctgcgaaagcgaaagcagcgccgaagaagactcagacgaagacacagacagccgcatcaaaagcacagggacgtccgagaacggctcagagaaggaatacgggaacggtaaagatcattcctctcggcggcctcggtcagatcggtatgaatataacagcctttgaatataacaacaacattttgatcgttgactgcggtgtggctttcccggatgacgagatgctcggaattgatttagtcatcccggatgtgacctatttaaaggaaaatgcaaagaaaatcaagggactggtcattacccacggacatgaggaccatatcggagcgatcccttatattgaaaaacagctcaacattccggtctatgcaacaaaacttacgatgggactgatcgataataagttaaaagagcatggactgttaaagcaggtgaaaaagacagtcgtaaaacacggcgacgtgataaaactgggagtctttacggtagaatttattaagaccaaccacagtatcgcggatgcggcagctcttgccatccacactccggcagggctgatcatccataccggtgactttaagattgatcatactccgcttttcggagaggcgatcgacctggcaagatttgcagaactcggaagagagggtgtccttgcgcttatggcggacagtacaaatgcagagcgcccaggctacacacagtctgaaaagaatgtaggcaagacactggacagcttatttgcggctcatccaaacggaaggattatcgtagccacatttgcttccaacgttgaccgtgtgcagcagatcattaattccgctcacaaacatggaaggaaggtagcggtagaaggccggagcatggtaaatatcattgcgactgcttcagagctgggatatatcaaaatccctaagaatactctgattgagacagatcagatgagaaatgtaccggacgatcagatcgttatgatcaccacgggaagccagggcgagactatggcagccttgtcaaggatggcaaacaatacgcaccgtaaggtttctatcaaacctacagatacgatcgtattcagctccagtccgattccgggaaatgaaaaaaatgtctccaatattatgaacgaactggcgatgaaaggcgctaaagtcgtattccaggatacccatgtatccggtcatgcgtgcagagaagaactccgcctgatctatgcactgacgaagccgcagtatgcaataccggtgcatggagaataccgtcatctggtgcggcacagtgagttggctttggagatggggattccgaaagaaaatgtttttgttatggaagaaggagatgtcctggagataaacaaaaaatccgggaaagttaccggtaaagtccctgcccagggaatccttgtagatggactgggcatcggagacgtaggaaatattgtactgaacgacagaagacagctgtcacaaaatggcctgatcattgttactgtgactttggaaaaacacggaaacagcattttggcaggtccggatatcgtatcccgtggttttgtctacgtgagagaatctgaaagcctcatggaaggagccagacaggttgtggaagatgcggtggaaagctgtctcacaaaaaacattaccgattggggcaagttaaagtcctgtatccgggacacgctgagcaattatatctggaagaagacgaagagggatccgatgatccttccgatcattacagaagtataaagctttacgcggggaaggaaagtgcaaagacagatgatgacaaaggatgaagagagaaaaaacaatagagatgacctgttccggcttttttggaaggtgatccatcagatactgatcataggtctgatcgttggattatttttcggcatgtattcttttgcctatcatgctttctcaaacgaggcatacgatgcttccagcaccagaaagattcaggtggtaatctccaaaggagacgggaccggaaaggtggccgatcaactttatgagaagcatctgatcatcggtaaaaacagatttaaagtaagaaaatttttctcaaaatataaagaaacggagtttgttcccggcaagtacagtctgtcacagtctcagggtattgatgagatcatggcagtgctgtgcggggatatccgtgaaaaggagaaaaaatgattgtagatgaaaatgtaacagattatctccgttcattgatcagggaggaggacgcttttcttgaaaggattgagcgtgaagccaaaaagaatcatgtgccgatcgtgaagcctgagacaaaagagtttctgaaattattagtgctgatgaagcaaccgatgaaaattttggaggtcggaacggctgtgggattttcatctctttatatgcacaagtttcaaccggagggcgggactgttgtaaccattgaacggaatgaaggaaggatactgaaagccgaggcaaactttgccgaagcgggggtacaggacgcagtgactctcttgaaaggggatgctgtccagatcctcaaagagctatccggaacctttgattttatctttatggatgcggctaaaggccagtacatccgtttttttgaacatattttacggctgcttcctgagggaggcattttggtttccgacaatgtgctccaggatggggatatcgtaagatccaggtatgcggttgagcgcagggaccggactattcacaagcggatgagggagtacctatatacactgaaaaaccaccctctgctggagacatccgtgcttcctgtgggagacggggtggcagtgagtatgaaaacaggagagtaacatgagaaaaacagaactgcttataccagcaagtaatttggaagtactgaaagtagctgtactctatggagcggatgcggtttatatcggaggagaaatgtacgggctgagagcaaaagccaaaaatttctctatggacgatgtaaaggaaggaatccgttttgcccatgagcacggagtcagagtttatataacagccaacattgtggctcataacggagacctcggcggtatccgggaatacttcagggagctgaaaagcacaaagccggacggactgatcatttccgatcccggtgttttcatgatcgccagggaggaatgtccggagattgaacgccacatcagcacccaggccaacagcaccaactatgccacttataaattttggcatgaacagggcgcatcccgtgtggtggctgccagagagctgtctcttcgggaaatcaaagagatcagggagcacatcccggatgatcttgagattgaggcatttgtccacggggctatgtgtatatcccactcggggcgctgtcttttaagcaattattttaccggacagaatgccaacaaaggggcgtgtacccatccgtgcagatggaagtattctgtggtggaggagaccaggccgggcgaatatctgccggtgtatgaaaatgaacgggggacttatatttttaattccaaggacctctgcatgattgaacacatggatgacctgatcggcgcaggaatcgacagcctgaagattgagggaaggatgaagactgccctctatgtggcggcggttgcgagaacttaccgaaaggctattgacgattacaaggagtcaccggagaaatattttgccaatatggattattacaggcaggagatttccaagtgcacttaccggcagtttacaacgggattttattatgggaagacagatgaacattctcagatttatgacagtaatacttatgtgaaggaatatacctatatcggcatcgtgcagggacacaatgaaagagggtatgcactgctggaacagaaaaacaagtttctcgtaggtgagaccattgaggtaatgataccgggaggagaaaacctccaggtgaccgtaaaagcgatcgaggatgaggacggcgtttccatggagagtgccccgcatccaaggcagatgatctatgtggatttcggggaagaaattccggaaggatatctgctcagacgaaaagaagaataaagttaagtttcaaaacatcggcaatatttttatgccgatgtttttttaacatgacatgggatgacaagttcagagtggtatcatttattgtaggaagggagatgaaatttcttatgaaatatgaatggagaaaacaggagaaggagatttacagcgcaaaacaggagccgtctctgatcgagatacccggacagagctatattatgatctgcggggaaggtgatcctaacaaagaagatttttcagagagagtcggtgttttatattcacttgcatttcaaatcaagaatggatataaaaaagcctgctcagaaggttgcgttaagaagatcgacagtcagtatgaggactatgcagtctatccgctggaaggaatctggacgacctctgatccggagcatcctttggataaagaccgctttgtttaccggattatgctgaagcagccggacgtgatcacagaggagatgtttaaagaagcatatgatgcagtagcccgaaagaagcctcatcagctgctcaaagaggtggagtttttctctcagggggaagggttgtgtgtccagatgatgcataaggggccatttgacgatgaaccaaaatcctttgcgaagatggataagtttgtcaaagagaagggatatgaaaggcggaatcactggcaccgggaaatttatgtggcaggagccaggcaggccgattcaaagaataagaagacgatcctcagatatgctttgaaagataaagcctacccaccgggcacaccgcattttcagggttttgggcgaaataaaatacggtacagcaagtatacaatcatcagcccggatagaacaaatccaataaagctgatccaggggataccaaaaattaatggtttcatctccgtcatacagagaagacttgctccaacaaagagagaggaagagatgatcccaagtacaagataaccggcggaacggtgaaacattttcaccaggtcatctgcatctgtgagctctaaatttaattttgtctgcccgttttttgcgatatttaacaggtcggaaagctgggacgggatctccatggatttatcaagagacgcataggctgtccgaccccggcggatcagttcttttttccagtcaaggtcatcatagattatggatgacatatgcacagaaaggatcgagagcatattgacttcgggggagcaggcggccaatgtgccttccatggtaatcatgctcctgccgaggagcgtgatatccgggctgatggcgattttatgcttttttacaagatccagaagcttctcaatcaaatctcccaggcgcatctcgccgaagtccaaagtcatataacggctgacgatatcatccacgtccgtatagagcctggcatgattaatgcggtcttttggctctcccagggtgaggaggacatttttcagcgtatagatgtcgtgcattaacagggctgagatggcttttctgaggagctgtttatagtgttcagacagatgtcctgtcatgccaagatccagccaggcaatcttccctcccgcaatccacagatttcccggatgcgggtcggcgtggaaaaaaccatcctccaggatctgtttacagtagttttctgcagctttctcgccgatctccgtcatgtcatatccggccttgcggagtgcatggatatgatcgatctggataccatcgatataggtcatagtaagcagacggggtgtggtaaactcagtgagcacctgcgggcaggtgacataggcaatgtctttttggttttcataaaaccgcaccagattgtccgcttctcttataaaatccatctcttcctgagaggttttccaaagttcatccagtatcgtattaaaatcgatcaggtcaccggttcccatggcaattttcatgattttggcggctttttttagaaaatgaatatcattttccatggtttcccggatatgaggccgctggactttgatgacaactcgtccgccgcctgcgagcaccgctaagtgaacctgtgcgatggaagcagaacctagcggagccggacggatctcagaaaatgcagattccaggggacggcagagttcctgttcggccacctgtttcaccagagaaaagtccagcggttttacttcggtcctgagtttttttaattctgtacagtatgcttcaggaagcacatcagagcgcatggacataatctggcccagcttgacatacgtaggccccagatcttccagaatctctttcagcttttgaggggtcatcccccttgagagatgatgcctttttaacaccgtgagaatatctaaaagccgccggttagagacatcactgctcatcttcttttgattcctctggggcatcctcccgaatctcggcatctgcctgctttttcaaattgatcttttccattaaacggtccaaatcttctgcggacatatcatccacggcatcgatcaagtctccatagtcttttacaatatttacagtcacatgatctttcagtttttcttttgttttatgtttaagctcttcatttacaaccttgccctgttctacagtgagttcacctttttttacaaggtcctcgacgatatctttggcagagtccgccgtggcagccatagcaccgatgccggccagcaggatcttcttcataccttctccaatatccataaaaaccatcctttctacaataaaacaataaacacactccaaactatataataagtataccttatcgcgcggagcgcgtccacccgaagggtataaaatacggtgtgccctgtgggtataccttatcgcgcggagcgcgtccacccgaagggtataaaatacggtgtgccctgtgggtataccttatcgcgcggagcgcgtccacccgagcgacattttccgcatgatttccgttcggctcttagaatgcctcactccaatcatgtagaaaatggacgtaatacctgccggacaagtgttacttgaacaaaagaagctattttgggagagttcttttgtctaatgggtacttttctttggtacatggatgtataccattgattttccgacatatatgtcgtatagtttatttatagacatatatgtcggaaaggaggcgttccgtgaataaaagaggtgaagcgacgaggagattgatcagggagaaagcctgtcttttgtttgcagagaagggttttaaagaagttacaatgaaagatatctgtgagatcacggggttaagccggggaggcttgtatggacactatgagagcacaaaacagatttttaaagaaatcgtggatgaaatgatggactctcagaatgaggagtttcattcgaaaatgaagctgggactttctgcggttcacattctggacgatattttaaaacgctatcaggaggaaatgatcgacagtgaaggctctttgagcactgcgatttatgaatatttcagcatgaaggaaaatgccgccggggagaatgccttgtaccgtcagtatttaacttcctgtcatacatggaagagctttcttcaatatggcattgaccggaaggaattctatcctgtcgatatatctgcggtgtttgacctgatcattttttcctatcagggagtgagaatgtacagcagacttatgccggttaacagagaagtgccggaaagaatgatgaaggaaatccgaaatttattagtgagaaaggaataaaaagatatggcgactatatttgaccgctgcgacaatacaaaaacggcgttgataaatcccagggatgttataaaagaaaaaacggattttccggaggtatgcatcaccactttttcagcggacatgatcgaccggctggctgagttaaatgacggacagaagattgcagaattgtgcagcgcaaacgggaatctcccagtctatgaaatgcattatgccgggaagagcatcgcgttttttttatccagagtaggtgcacctgcctgtgcggccggtttagaagaaatcatagcactgggagcgaaaaaaatagtaatgttcggatgctgcggggtcctgaaccagtccgctgtccaggataaaataattgtccctgtttctgcggtaagagatgagggaaccagctatcactatatgccggccagtgaggaaatccatgcggagacatcgtctgtaaatatattaaagaatagtttaaagaaatgcggaatgtcttatgtgaccggcaagacatggaccacggatgcgatttacagggaaacaaggagtacagtgaaagagcgcagagaacagggatgccttgcggttgagatggaatgttctgcggctttggcagtcacgcagtttcgtaagattccgtttgtccagtttttatatggtgcggataatctcgatgcagacagatgggaacaaagagatctggcggagtacggtatcaaaagttttaataaatacatggaacttgcgtttgaatgtgccgcctccctgtaatataaaggctttcccggggacagcatatccgatataatatatatataaacagacagaacaaaaagatgcatcgttagaaaaggagcattcggcatgaaaaaaattagtgaagtcagcagactgacagataatccacatctgaatctgtatcatttaaaaggaacaaaccgggttggaaaaacgttgaattactatatcgcttccagggttaaaaatatggaacggctgaaattaaagacaaagcgcaatgatccggacggcattattgtatacagcctctacggtgaaaaacgagacagggtcgtgctggtcaggcagtatcgatattcgatcgatgattatatctacgaatttccggcaggtctggtggaagaaggagaagactaccgggaggcaggaatcagggaattaaaggaggaaacagggctttccctggaattaatcgacgccgatttgatgtttgaaaagccgggctttatgtctgtcggcatgacggatgagtcctgtgcaacgatttatgggtatgcaagcggcacaccgagcaaaaaagggcaggaggactctgaagagattgaaattgtgcttgcagacagggaagaagtgaaaaggatactgaaggaggaacatgtggccatcatgtgtgcctatatgctcatgcactttttacaggataaggagccgtttgattttctgaatttataatggacatttgcagtcgaggatacaaaaaggatacaaggatctgttatatttttcaacatataaatggaaagctgaggagaggaatatgaaccgtattttaatcgtcgaggatgagccggccatatcaaatttaatccagatgaatcttgcagcagcgggatactgctgtgtctgtgcttttgacggggcaaaggcggccgaccggctggaactggagagatttgatctgattcttctggatatcatgctgccggagatagacggctatgagctgatggactacatcaggcctcttgagatcccggtcatatttcttacggccaaggccaatacagaagataaagtaaagggactgaaggcaggggcagacgattatctgaccaagccatttgagattgcagaactgctggcaagggtagagacagttctcaggcgctgtcagaagacagaaagccgtctgaaggcaggagatctggagattgatatgtcagccaggatcgtaaaaaaacaggggcagcccgtaaatttgacagtcaaagaatacgagctgctcctgcttttgatacagaataaaaacattgccctattcagggactttatttatgagaagatttggggcagcggatacatgggagacagcaggacagtcgatctgcacgtgcagcgtctgagaaaaaaaatcggatgggaacagaaaataaaaacggtctataaggtgggctaccgcctggaggattagcaatgaagttttcctggaaagtatttttaagcattatttcacttactatgctcacattcagcgttggcgggtattttttgatccagtcttcttttcagtcttctctgcgccagaccgtagggatgtcatatcaggaaaataatattttccgggcaactttgggggcttccattgccgtatctcctccggacagcggttcaccgagaaacacggttaaaaagctggccggatctatcagtctctcatctccgggaaaggaaagaaaatttcggatttgtgacagttccttccgggagctgttttctgatctgagttttcgtgtaccggatcaggtaatgaaggctctggacgaaaaacataccggatactccattctcaaacaggacggcaggtattatctgcagtcggcctgccgcttcaccgtggatgaagaagtattttacctggaaaatgtaagagatattacctcgatttatgaattaaaagaaaatcagatgaagctgtatcagaagatatccattattctggtcgtaactttgggaattgctgttttttgtctgtccagatggctgacccggcctttgagaatactttcccgggcggtcagaaacttcgctgcgggcgatttaaagatccgctcggaagtggtgtccgaggatgagataggttttctcgccggagattttaatacaatggcagagcagctggaacaaaagatctatgaacttgaagactccgcactgcgccaggagatgtttatgggaagctttgcacatgaattgaaaacgcctatgacttctatcataggatacgcagataccctgcggtccagaggactcagtgaggagcagaggtttcaggcggcaaattatatttttgaggagggaaagcgtctggaagctttatctttaaagctgatggatctgatcgttcttgacaagcagaagatttccatgagaccagtctcggcagcagagctgtctgaaaaagtcattcatcttacagggcctcttttggaaacatcaggtattcagcttgaaacttcttttgaggaggggatcatatggggagaaccggatctgcttcagagtctctgtgtgaatcttatggataatgccaggaaggcagtggatgcggacggactgattcgctttgaagggagatcagatgaaaacggttatattctggcgataaaagacaacggaagaggaatggcaaaagaagatgttaacaggataacggaagcattctatatggcagataagtccagagccagaaaagaaggcggagcgggtcttggactttctctttgccgccggatcgtggaactgcacggcggaacgatgaaatttgagagccggctggaaagaggaacggcagtcacagttcggctcagaaaggagaggttcgatgaaatttaagaatgttttgatctgccttttctcagcggccttggcagtctcctgtattttatggccgtccctgatatcgggatatcaggataagaaaatgaggggccgggtggaactggacaaggtggaagatgcatcggaaatccggacagataccttaaccatagccgaaaaattagcactcattgtggaagccgataactcaatggaggaaattgccgtgacgaaccagtcttatgagtggggatcggcagaggtagaagaactcaaaaaggtttgtatcaatgaattaaaaaaattgaaagagatgggaatgtttccaaagcttgacctgaataaaaatacaatgatgttttatgaaactaccacgacttatctggatacaaaaaattatgcaagacgtctcagagtccaaactgtatctatacagtcagcggatcaaagtttgtcactggtcattgatgattcttcacataaaatcttaagcctcgacagtgtaaaaggaactggaatcaaggctgtggatgctgaaaagatcatagggatttgggaccggtaccttggattgagagaaacaaacaaaattgcagtaataaaaaccagtcattttgtaagatacaagtcaggcagtgaaaatgtgtgctattcatttatattcttcagcaaaaaatttgcggaagaaggggaattttatattcaccctgaagtaaattatggagatgaaaatagtgtcagcagatgatacaacttcgatggaattttgaatgaattgtgatacaaggtccgggtatgataataccagagataatattctctggaaagaagggtgacggaccaatgagaaagaaacaatatatacagaggagacataagtattttgtcctgcttgtattagagatcataggcgcttggatcctgacggttcttgtgatacagtactgtacgtctacgcagcagccggtaaaaaatacaataccaatcagcagatttgtaaggccaagacaaaaagaacagacagttaatattccctggaacttaatattaataaatcatgaaaattatgtgccggatggttttcggcctgacctgactacattaaacaacggatgtcaggtggaccggaggatactgccggatttgcagagaatgatggatgcggccagaaaaagaggactttatccctccgtctgttctgcataccggacagaagagcgccagacgtatcttctggagcgtgatatcaataagtatttgaatcagggatgtacggaggctgaggccagggagaaggcatccagatgggttgcgcttccgggtcggagtgagcatcagacaggactggctgtggatatcgtggcagttgattatccggtgcttgatgagactcaggaaaagaggaaagaacagcagtggcttatggaaaacagctggaaatacggatttactctcagatatccaaagaataaaacaaatattacaaaaatcggatatgaaccgtggcattaccggtatgtgggaaagaaagccgcaagggaaatgaaaaagaaaaatatgtgtttggaagaatatataaaatatatttctggaggaatgtaaaaaatatcttggaagaagacagattaaaaattcccatgtgaagtttataaagagcaatttcatatgctcccatcttttctgagacggcatcctgaagttcacagacagcaggaccgcttgccacaagatcgatctggttatgcatggattcctgatcaagatattggatcatattttgtatattccccaaaaccatttcccattttgaattctcatcaatatgatataaatcgttcatagcagacctcctaaataaaacaatttatattgtaagtttaacacatttgagagaacccttacagccggtgaaatatcttttagagggaaaagcactattggacagaggaaggcatacaatgttaaaaaggcttggaggttgctttacttgcaggcatttttagaaccgctgtcacaggaagaggaacaatattacttgaagaaaagccgcctgggggacatggaggccaggaatatattagtagaacacaatctccgtctggttgcacatattgttaaaaaatataataactttgacagggataaggacgatctgatatccgtgggaacgattgggctgattaaagcgatcaatacctataacttggagaaagggcaccggctggtgacctatgcttcccgatgcattgaaaatgaactgctcatgatgctgaggcaggagagaaagagtgcaaaggacacttcgttatatgagccaattgggattgacaaagaggggaatgaaattaatcttttggatgtactgggggcggatgaaaacgatatcgtagatgaactggacctgaaggaaaaaatcagagatttgtataaaatggtggatgagatggaaccgtccagggagaaaacaactctgatcatgagatacggattatatggcaaaaaacccatgactcagaaagaggtggcaaaagaacttcatatatcgagatcttatgtgagccgtattgaaaaaaaagctgttgagaagataaaaagaagattaaaactataatcaggatatctgccggaattgtaaattagatcccggcagtttctattttctgtaagtaaacttcggttgatagaagccggagaaacaaatataattgaaaaaaacagaatcaataaacaggaccggccaaagccggggaggaaataaatgaggatagaaattgcaaaactgcatcgttcaaggcttcaggaggcgatggatcttatgtgggaaacctttgcttccaggttccagccaaaagatttatttgaacttgtgcgtaaggaagatattgaagagacaataagaaagggaaccaatgatgatggttccctttctttctattaaggaatatgttatgaaaagagtttggggaatattatttataagtattccatgtcggaaagtactcttaaaatgttatgtccttcctgaacaccgtcgatgatacgtcttgcacggacgctgtcaccgatattgataatttctacgttggtatccgcatatacctcacggatctcctctaggatcggagcgttggcacgcattccgagacagacgaatccatagtcaaatggcaggtctttttcttcaccgtctgcttttacgaggaaggaatcggccttgacttcgcagagagcagtgttcggcatctggttgaccttatactttttcatcagtgcattaacaccggatttagaaacagggtctaaatctttaccgatggcaggcatcatctctacgatgctcacctctgcgccttttggtgcaaaatattctacaacatccagtcccacggcaccgcctccgatgacagcgaccttcttgcctgtgcagtcttccggatagtcagccagatgattgatcatgccggaaatagaggcaaccttggagccttccttgtcgatatggtcgtgaagacctttgatcggcggaagcagaggattggatcctgtggcattgacgatgatattcgggtgcagagccttgatcatcggcagtgtggcttcctgtcctttaaagataaacaagttgtttaacctggatgcccttacttgaagatagtgagggaaatcagcgagacgtttcttgtcaggaatcttggagatttccacggaaagtcctcccagatgatcttccttttctaataagaatgtcgtgcagccaacttccgcagccgtacatgcagcttccaggccggcagtaccgcctccgataacgacaacgttgcatggtttattgatcttgtgctttttataatcagcaccgtcgtttaccgtaggattaatcgtacagcggatcgggcggttgacaccgattcggtttcctgcgcatccgatgttgcaggaaatgcatttccttaattcatcttcgtgccctgtggcaacctttttcacccagcatggatctgcgatgagaccgcgtcccataccgatgatatcagcgtctccgcgggcaagaatatcgtcagcaacacgtggatcacgaatattacccatagtcacacatggttttccgtatttttccctgacagcctttgccatataagatctccagccgtcttctaagtagttggcgtcgatctggtactggatggaaccgtttaatccggcagacacgtcgaaaacatcgacttcttcctggaaatactggaggtagttcaaagtatcatccagggtatttccatgttccataaactcgtcggcacttagacggacgaagattgggaacatcggtccaacctgttttctgacttcttctaataccagccttgcaaatctggctctgttttccggagaacctccaaattcatcagttctgacgttagtcgtaggagataagaactgactgatcaggtaggagtgtcccgcatggatctcaatgcagtcaaatcctgaagcctgtgcgcgcgcagctgcctctccatattttttaacaattgcataaatctcatcttttgtaagcggacggggaatttctccgccttctttggatggaatatttgatgcggataccggctgtatattagtacgtttagactgagcggacgcacctgcatgatttaactgaagtccgatacatgcaccgtgggaatggacagtctcacagagtttaaagaaacgcggcatgtaattgtcgtggtcgatcctgatctgagttgtaccgtttgaaccgagaggggaatctacgctggcattttccaccataataagaccgacaccgccttttgccctctgttcgtaataattgatatggagaaaactcatctctccggtctgttctccatagttggttcccatcggtgtcatcatgatgcggtttttcatcgtcatgtttttgattgtcaacggactgaaaatatttttataattgcacttcattgtgtaccctccaaaagattatcgatttctaattagggttgttatcattgcatttgggtgatctgtaatgataagttcattataaagcaaagataattatttaacaaattgatattttttttgaaatcaatagtttttgtctatcgttttttttacgaagacaataaatttctctacagcagggatcataatgttgttcttcaggtacgccatgtagacagtgtgataaggtttcacgttgcttaagtgaaggatctccacgtcatattccctcagagattccacatgggccacgaagccgatgccgaagttctcggctacgagagcggcaatggcattttcatcggaggtttcaaatgcgatctcaggttccatccggttttgccggtagatggaagttgtaaactggcccaggccggaagtgcggtcatatcctatgactgggtaggacagaagatcttccagcagaacttcttttttatgcttcaaggggtgctccagcggcgtgatgacaaccatctcctgattgatgaccgggacgaattcgatctcaggctcattggatacgtaagagccgaagatgacgtcatatttttcagacttcagatcacggagcattttgttagtgatttcctgcgtcatggaaaaggtgatattgctggaaccttccgaatttaagaaactgcgcacgaggtggggaatatacgatttggcaagtggaaacacgtaggccaggtcgatgtggcctcccttggagttggccagagccttcattttatcctcagcaatcttcacttcttcgagtattttattgacatgctctaaaaatatctttccgtacttagtcagctcgatatttcttccatttttccggaagagaggaagccccagttcctcttctaaattggcgatggagcggcttagactgggctgggatacattcaattctctggctgcctgatgataatgctgcagggttgcgattttttgaaaataagaaagctggtttaaattcatagagagtacctcgtttcttgggaaagtgcaatggctatttatataaggaagcataacataaatgatagcaaaaatctattaaaaagtattaaaagatgtattagaagtatcaataagatccgtgtataatagtttttgtaaggttgttaaaaaattaacttttgggtgaagaaacaacagggtaagtagaaaaggagaatgacacatggcagagagaatcacaggacatacagaattgatcgggctgatggcatatccgatcagacattccagttcaccggcaatgcacaatgaagcatttgccacattaggacttgattatgcatacttggcgtttgaagttgacaatgacacattagaggatgcggtaaaaggactgcgtgccctgaaactgaagggttccaacgtgtctatgccgaacaagacagttgtaggcaagtacttagataagctttcaccggcagcagagatggcaggagcagtcaacacgatcgtcaatgaagacggagttttgacaggacatattaccgacggaatcggctacatgcagtcactgaaagacaatgacatcgatgtgatcggcaaaaaaatgacaatcacaggagcaggcggagctgcaacggcgatcgaaattcaggcggcactggacggtgtcaaagaaatgtcaatcttcaatatcaaagataaattctgggagaatgcagagaaaaccgttgagaagatccgtgcaaacacagactgtatcgtaaatctttatgatcttgatgataaagataaattaaaagaagagattgcagacagctatctgtttgcacaggcaaccggtgttggaatgaagcctcttgaaggccagtcagtgatacctgacgcgtcattcctgcgtccggacctgatcgtcaccgacactatatatgcaccgagagagactgcacttttaaagatggcaaaagaagccggctgcaagacaatgaacggtcttggtatgatgctgttccagggagacgcggcattccacctgtggaccggaaaacatatgccgatcgaccacatgaaagaagtgttggatattaaatacgactaaatctagagaggaaatttgagaggaatcaattatgaacaaaaaatattatcccagtgcgtttattttatacttaaattatttcatccatggtatcggatgttctgtattaggccaggtagcagtaaaagaaactttggtaaagcagtggggagcttctgacatcgggctggtaacaatggtagcggcagcgctggggcttggacgtttgatcgcccttccatttgcaggacctctttctgataagctgggaagaaaagtggcatccatcatcggcgcaggctcctatgcgatctttttcttaggccttgctatgtcaccaaatatgacggttgcatacatagcagctgtattaggaggaatcgcaaactcattcctggataccggtgtgatcccggcttgtgttgaaattctggctccaagatccagtatggcaacgatgctcaccaagttttcaatctcctgttcacagctgttaatgccgtttatgatcggtgccatcgttggagcaaacctttccttaaatgtattattatacgtatgcggtgttgccattgccatcatcggcgtgcttgttttattcgcacctcttccgaagatggagacagcaggcggggcaaaatcttctctgatccaggatatcaaacatgcaaacttctcattggagagtattgcgctgattatcatcggatttacaggaacagcaacattccagctctggctgaactgtgctcaggatttcgcgaaggaatatgcaaagattggtgatccttctgtgatgcagacatactacagtacgggatctctcgtagctatcgttgttacaactgttttagttaataagataaaaggggtaagattcttattcgtatatcctctgatcgcagcgattatgattgcgcttgtttatctgctgagaactccttctatctgctacatcggatcagcagttgtcggatattccgcaggagccgttgtacttcagcttgtgacagcgacagcgaacgatctgtttccgaaaatcaaaggaactatcacgagtatagttatgattgcgtccagcttatctaactatacaatcctctctctggctggtacaatggataaagcagacattttattaatgaacattggaatcactgttgtcggagtattattggctctgtttgtcaatgtgagatacaaggcaatggaagagaaagcttaataaggagtagaaaatgaatccagtaaaagttaaaaatgtagagattggaacaggtgttcctaagatttgtgtgccgattgtgggcgtgacaaaggaagagatcatcgccgaggcaaagtctttccgggagatcccggtagatgttgtggaatggcgcgtagactggtttgagggagtcttcgattttgccaaagtagaagatgtgttaaaagatttgagagaagctctttcagatacaccgattctctttaccttccgtacatccaaagagggcggagaaaaagccattgagccaggtccgtatgcagaactgaataaaaatgcagcgagaagcggatatgtagatcttgtagatgtggaggtatttacgggagatgatatcgtaaaagatatcgtggcggctgcgcatgaatgcggcgtaaaggttgtggcttccaaccatgattttgacaaaactccttcaaaagaagaaattgtcagcagactcgtgaaaatgcaggaattaggagctgatattcctaaaatcgctgtcatgccgacctgcaggagagatgtacttacactccttgcagcgacggaggaaatgtatacagatcatgcagaccgtccgattatcactatgtctatggcaggaacgggactgatcagccgtctctgcggagaagtgttcggttcggcgcttacattcggcgcagcgaaaaaagcgtctgctccgggtcaggcagcagtcaatgaattaaatgatatgcttcagttcctccacgcaaatcagggactgtagaattataaaatcaaaatgacagtaagataaaagcagataatctgaccccaggttatctgctttttacttctgcggaccatagatgatttgaggcggcaggatcattgaactctgagaaaatttgcaatattgatagataaaaattattaattctatttgaaaaatctatttgtggaatgaattattaccatgtataatatagtggattggttgttaaaaaattaacttttggatgctgtaataattacagcggggaatcatgttcaaatagatagaatcatgctggggacagcagatctccgcttacaaaagagaggtattaatatgctaaagtggttagatgaaaatttagaagagtttttaatgggagttttcctgatggggatggtcctgatcatgggcatacaggttttggcgcgttatgttctgggagcatccctttcctggtcggaggagatcacaagatacctgtttatctggtcaggctttatcagtgtcagctactgcacaaaaaagtgtatctccattaaaattgagcagtttgtggcaatgtttcctaaaaggggaagggccatctttaaagtggtgaaccataccattgaacttgcattgttcctgtatctgatcccatactctatcctgtatttaaaaagtgcatttgaaagcggacaagttagccctgcatgccatataccaatgtactacatacaggcagcaccgctggtaagttttctgctggtgacaattcgtattttacagagatggctgattgagtttaaaatcgcagttggaaaggatcaggaggtgtaggtatgtcagcgttatcagtatttattattttctttttgtgtttgatcattgcgataccgatttccattggactcggtattgtgtcggtacttccgggaatctttgactcttcttttacggcaagcggccagtttgtcatccgttccatgctgggaggaatcgacagttttccgctgctggcggtgccgatgtttgttttatcaggcatggtgatggcaaagggcggaatttcaaaaaagatttttgatgtatttgtatattttattggaaaatttacagcgggaatgccatgtgcagttatcgttacgtgtcttttttatggagcaatttcaggttcagcaccggcgacggtggcagcagtgggcagtatgacgatcccgattttaattaagctcggttatgataaaaaatttgcgacagcaatcgttgcggtttcaggaggattgggtgtcattatccctccaagtatcccttttattatgtacggaatggcatccggacagtctgtcagtgatctgtttatcgccgggattcttcccgggatttctatcggtctgctgctgatggtatatgctgttttttactgcaggaaacatggtgaggataaagaaaagatccggaaagaagtacaggcacttcgtgacaaaggcctgcttactgtgctgaaagacagtttttttgcactgctcagtccggtcattatccttggctgtatttatactggtgtggcttcccctacagaagcagcggtgatttctgttttttattctgtattcgtaagcttatttgtctacaagagtatccatgtaaaagacttatggggagttatgatcgagggaatccatacctatgcgcctattttatttatactggcagcatccgtggcattttcaagagtcctgacgctgatgcaggttcctcagacagtcagcgagtggattcttggaacattccacaatggaattgtcattctgctggtaatcaacgtcttcttactgcttgtgggtatggttatggatacgacaccggctattttgattctgacaccgattctgatgccgattgcagtgggcgttggaatgaatccaattcattttggtgtgatgatggtagtcaacctggcgattggttttgtaactccgcccatcggagtcaatttgtttgtggcttcatccctgactcagatcccggtagtggatatcgcaaagaaggcaatgccgctgatcctttgtttccttgtggctttgttacttattacatttataccgcagatcagcctggcgctgttataggagggggatacagatgaaaagattgataagatttggtattgcggctttatgtgtcgtctctgtcttggctcttagcggatgcaagaagaaaagtgatgacggtgtgcagcggtatgcgtggcctcttggaacttccagcccggaagataccgtgacgcagctatattctcagaagtttgcagatgaagtaagcagattgagtaaagggaaaatgaagattgaggtatatccaaacagtacgctggggggagacagggaactgctggagagctgttctgacggtgatattccttttgttgtgcaaaatacggcacctcaggttacttttatgccggataccgctgtctttgatttgccaagtgccttcactacgattgaagaggcaagagctgccgtagacaatcctgtattttataagaagatggaaaaggtttatgaaaaaggtggatttaagctgcttggttatgcggaccagggatttcgtgtcatgtctaccaacaaagaggtgaagtcgattgatgactttaaaggacagaaaatccgtaccatggaaaacagctaccatatggatttctggaaggcactgaaagccaatccgacgccgatgacgttcagtgaggtatacatcggcctgcagcagaagaccatagacgcacaggaaaacccatatgaggtcattgtgtcaagcaaactttatgaacagcaggattacgtggtagaaacaaatcatctgccccattatatttctctgattgtaagtgatgaattttataaagaccttccgaaagatcagcagaagattattgaggaggcggcagagacggcaaaggaatatgcaaggaaagcttcggatgaacggatcgaggaccggatgaaggtcataaaagatagtggtacaaagattgttgcgctggataagaaaactcaggaggacgtaaggaaagcggcttccgacatatataaaagcattaaggaaaatgtatcaaaagatatttttaatgcatatttgaatcagaagtaagatcagcaggctcttttattggaaagcaataaaagagcctgttctttattttacaggaaaggttctgagtgatacacaatatttggatgaactttcacccgcagttgaactttgcaccgcagccgagagtaaagacagaaagcggagaaaaaataaaaggttttgtgggagtttccaaggcatctaaatttgcagtgaaaggaattgcactgattgttatcggtcgcacctgtacagccacattccagatctttctcgctgtaatgttcgttatggaatattaccttctggtagctgtagaattaatagatgacggagatactctggcagtttgcggagccggaggaggcattgtagatccgttactattgatcgaagctctgaaagacagatatctggagacaaaggagccaaaaaatttgacgctgtggcatttcagcggactgggagaccgtggggaccgcggaatgccacctgaaagagaagcgctttaaggcaataaacttgcacctgctggagttatactatataataaaagaaaatattgtcagcaagatcattggcaaatactggtgagggggaatatataccagattatgaataaaaagtgcggagcgactgtattacttctgctgtgtgtcttgtttctggcctcgtgcaggggaaaccatgacaaggacaaaaaacagataaaagaagagtcatatacagtgataaaagattccaccgggcgaaaagtagagataaaaaaagaaccggaaaaagtagtagcgttatcggcttccctgtcggatgtatggctgctctccggaggagaattatgcggagctactgcagatgtgctggaagaagaggtagttcacgaaaatcttaacaaaaaaaagattaaaaatgttggttctgtcaaatatccggatctggatgctgttctttccctgaagccggatttggttctgatttcaggaaacattgaggagcagatggatacagctgagactctaaagaaagaaaaaattccatattatattgtcaggatgaatactctggacgattacctgaacgttttaaaacaaatgacggaagtaaccggagaagaggataattatgaggagtatggagagaaagcaagggaggaagcggattacctgctgaagcaagtaccaaaaggcaggaaaacgactgcactggtgctcagagcttattctgcagacatcaaggtaaagacagaggaaaatgtagtctgcaatatcctgcaggacatcggagtagagaatgcagctgcgaacaataaaaatcttgcggaaaataagactccttcactggaggcgatatcaaagagcgatcctgattatatttttgtcacaaccatgggagacagaaagcttgccctgaagaagcttcataatactttggaaacggaatccggatgggaggatttgaaggctgtgaagcagaagcaccttgttattcttccgaaagaactgtatcagtataagccaaacagccggtggagcgaagcctatgagtatattctgtcgattgtatatcctgatacttttcattcggcagtggaagagagcaaataaataattataagggaatacaattaagagaagataaaaataaaaaagcaccccattggaaaatgttaaaaacattgatgccaatggggtgtttttttattttgtatatttttggatgatagcttttagaacatctggattttcttttatccagtcggaatataatttgtgttctttctgtactgcctgtccaatttctattaagaagtccggaatatctgtttccagaatggttccggcgtcctccccgaactgtgcattgccctgtgtttcctctccgccgatatacagttggaaggctgcaagaggttttttatcaataacctttgtggctccgcggaagccaagtgtcccaatctggtgagttccacaggaggatggacagccggaaatatggatctgcgggagcacaccgttcgaaaaatctaaggggcggatcttatccatgacagctttatagagcttttgagagtctctgagacctatctgacagatcccgctgccaatacaggcgacagatgtctcaaacaggttggatgcactgtctttggtaagttccaggagttccagggcttcctctttgttacagttgatgaaataaaggctttcgtctggggagattctcaggaccacctggtccatcttctgtacagcttcattgatcggtgcgatcagctccggcgggatattccctccaaacggatgatataaaacactgtaaagaccgtcctgtttctgtgcggtaatccggaagttttcctcaaggaagccgcagccttcttttgtcacaggaacttcctgtacattgaggtcaagagaatcttcagccattgccttgctgaggttttcaagaaaagcagcccggtagccttcctggcccaaagtatcctgcatataccgtgttctggctttcccgcggttttcatagttgccgtgctgtataaatgtcagaatcatagctttaatatagtacagtacttttgatgggtctgtcccttcgtctacgagtatgcccattttaggattgttgccaaggccgccggcgctgtaaacgtcgaaggtgtgatccttgcgggcaacaaatccaagatcacggaaagtggcgtgtgttatattctttggagaattagagaaacagactttcagctttctgggcattttcacccgtttgatgaaagtcagaagataatcggcggcctctctggcatatggaagcacgtcaaagtattcttctttttctactccggagagaggagaaaccatgacatttctgggaaaatcaccgccgccgcctctggtgataatatcatgctcaaacgcttcctcgatgagggaagatacggtaacatcatttagattgtgtacctgtacggtttgacaggtggtcagatggagtttgtctatcttatatttttcaacactgtccgcaataaactggagtttatctttcgtaatttctcccccggtaaaccgaagtctcagcatactggaaccgccgcccctctgtgcgtagcttccaaatcctcctgaaaaacctttatattctttaacgctgatttctttttgataaaactttctggtcattaaatgaaattcggccaggtcagcctgaaattctttttttaattcctgatccatgttattctcctttgccatatttaacagttttcttattttattatagcatttcttaaaatgcacgtccacattcagggaagtttggctttttttcagttatatgctagaataggacaaaagaaaaataaaggatggatacacagaagatgtttgagaaattttacccgaatgaatatatggacagtacttattccattgactttaaagcatattatgacagaggataccgggggattttatttgatgtagataataccctggtgcctcacaatgcacccgcagatgaccgggcagtccgttttttcagggaactgaaagacatcggctttgatttttgttttatgtccaataacaaggaacccagagtgaaaaagttctgcgaagcagtggaaggaacctactatatttataaagcgaacaagcctatggtgggaagttatgagaagggcatgaagctgatgggaacagaccggtctaatacactgtttgtgggagaccagctgtttacggatgtctacggggccaatagggccaatgtttacagtatccttgtaaagcccatgaatccaaaagaggagatacaaatcgtattgaaacggtatcttgagaggatcgttctgcatttttataagaaaagttgagtaaaaattattacatgatttttatcgaggatagtatgctgattgtagtggaatcagcatactattttttgtttttgtaataaagaaaatgtttatatcaagcaaatattaaaattatattaggaattaataacattatggtataagtagtcataactgttgacatagatggttctacggattattatttagtatataactatcagattagtaaagaaggaggaagaggtatgaaaaaataataagcatatgttgtatagttttaggctttattctatttgctttgcagaatacatttgccaatgaatttgttgaaaaagaatcaactgataatgttcaaattaaaaaagtcttgaataatttttttatggataagaataaagctttagcccatttaaagatggattccaaattaaaatcatattttaattctgatgaaaatttagagtattttgatttagatactttaataaagtatcgtaaggttcagaattcagatctgtgttttgaaaaatttaattctgaacttacttataataagattttaattaatgaaagcaaggcaaaagtatcattaactgaagatattaaaatccattataattgttcaaaggacacagaatcagaggaactacatgaacatttgatttatttagaaaaaataaatggagagtggtttatacagaatgataatgtagaaggagactttaaacaagcactcaaaacgatgaaagataagcaaaccgataaagccgctctagagaaaaagcaaaaagatataattaaggttgccaaatcttatgttaataaattagagcaggaacaatctaataacattcaaagttatgaaatgactgatactagtgcagcaaagaaaaaatataaatttagtagttatgatagaaataaggctaaagcatatgcattaaagtacgctttaaagcctaatccaaattatccattttattctggggatggagactgtacaaatttcacttctcaatgcctaaaagctggcggaattactgaagataaagaaggtaaagaagcatctaaaaaatggtatagatacaattcatcatggaaaggtgcacagatgtttcacaactactggcgagaaaataagggatcatcatcagtaaagggcttgaaagcatctaagactaatatgaaaggatgcagattaggtgatattgttcagaaagtaccatggaatagtaaggtaggacagtatacagctacacacagtgtaatcatttctggttatgtccctaatcctactactccaggtgatccatggaacagaaaaaaggatgtttttatttgtcaacattcaagcaataagaaaaaagacatgttgcgaaacgtcccactgagttctcgaggatggatgacacaagcgaaatatgttcatataagtggttcatataaatgacagaaaggtaggattatgagaaaaaaaatacttcaattacttatttccgtatttatcattgtttttggaacagcgtgtcaggctacgggcattaaagagcagaaaaaatatcctgagacaaaaaaagtaaaaacagaagatatgaaaacgttgaccaagcaacaattttataaagtaaataaaaaaaaatcagccccaggtgatggatgggagctgatatattacaacaaagacaaaatattaatctcaaatgttacatctcttgtaattctgagaaaagcagatagtagatttcaaattgataaaatattagatttgaaaaagtatgatttgaatcattcacagtcggaagagactacagagttacttcccagtaacaatggggaacaaatcttgctctataactcatataattctgacagtaaattattggcggaggaaaatgacagtctaatcagctgggttgcaaattttacaacagtaacaatgaaagagtatagaggaaatgatctcgaaaaaattgcagatttagaacaaggaagtttttttaactgtctgtatacatgtaaaatgattcaaaacccaagaaaaataaagggggttgacgaaaaaaataaagaaatcaaagtatttacaacagcttatgatgacacccagattctagtgagcactgatattaacgaaaacaacatgttatccttaaaaatcagtagttataatacctcaacaaaaagaataataaatctttttcggtttacctaataaataaaaagggtctttggaaaaagcatgacaatagcttttcccaaagacctttaaaatatcattaatgaaatttataagaagtgatgtctctccagtgcgatcaggatatcacgtccctctttgacaccttcgatcatacgccttgtctttgcactgtcaccaatgttgagaacttcaatgccctcatccacaaaatgatcgtacagagcctgcagcgccggtgtggcagactgcattccgagacagataaatccgtagtcaaaatctaattccagatccttatagtcatgacggacaatgaaagaattctctttcactttcaaaaggttggcattcggatactgagtgactttatatttctccaaaagctcattggcaccggttcttgtgatcagatccaggtcttctccaaaatgaggctttttctctacaatggtcacgtctgcttttctaggagcaaagaattcaaccacatccaaaccgacatttcctccgcctatgacaacgacttttttgccggaaagatctgttttttcaaatgtgtctaccttgtcaaccaggtcaaagattgtagagacatttcctttctcaaggttttccttaaggcctggaatattcggaagcagtgggttggagccggttgcgttgacaacgatgtccggtttgaatccgtctacaaattccgcggtagcttctacattcttgcagataaacaggtttttaagggccatggctcttttttcctgataagcagggaagtaaccaagacgttttttattcggcatgttgcccacacgtctggccagtccgccaagctggttggtcttttcgatcagaacagtggaacatcccacctctgctgcagtacatgcggcttcaaggcctgcggtaccgcctccgataacaaccacgttgcaaggcttcttgatatgctcttttttataattttctccgcttactacaaatggattgacagtacagcgcatcggtttgttgctgagcgttgcagtacatccattgttgcaggagatacatttgttgatatcatcggtgtttccgaactgtactttgttgacccactcaggatctgcgatcagtcctcggccgataccgatcaggtcagactggccgctctttaaaatctcattggcgatctcaggttcacggatatttccttcagcggtacatggctttcctgttttcttcttaacagccttggacatataagatttccatccgtccggaaggtaatctgcgtcatgctgatactggattgtacaggtaagacctgcggatactgcaaatacgtctacataatcttcaaaatattcaacgatctccaatgtgtcattcagtgagtttccgccttcagtgagctcatctgcactgattctcaaaaagatcgggatattctcgcctacaacttcgcggactgcttttaagacgagcgttgtaaagcgtgcacgattttctttggaaccgccaaactcatctgtcctgtcattggtcagcggggataagaactggttcagcagatagccgtgtcctgcctgaatctcaacagcatcaaagccggctgtgactgcgcgcttagcagcgtctgcaaacttctggacaataccgtggatctcttctatcgtaagaggtctcgggatgtctcctccagcttttgatggaatatcagaagcagataccggctggatatttgtcacagaaccgtccgagtcggcaccgccgtgattgagcagaatggaagcgttggatccgtattcatggatcgcttcacagagcttgtacagcccgtggatgtagttgtcatggtcaattctcaactggttcgtgcttaaagatccctgaggggatgcgacactggcaccttccactgtgatgaggcctatgcctccttttgcatgttgtttataatatgcaatcagtttatcactgacttctcctgttcgctcagcaaaatttgttccaatcggcgtcatgacaatacggttttttaatgtcattgattttactgtaaatggttcaaatagattgcggaaattctttgcagccatagttagttcctccatttttctttctatttcactgcaataattatatcaaactgtgtatacaaatgcaatgaagaatatacccacagggcacaccgtattgtaaatcctcggatgggagtgcttcgcacgataaggtatacccacagggcataccgtaactcatacccttcgggtggacgtgctccgcacgataaggtatactcataactaagaaaaccaattccggagggatcatatgaatctgaatcatctatattatttgagaacactggcgaaagagcagcactacaccagggctgcccacattttaaatatcacccagcccagtctgagccatgccatcaatgctcttgaaaaggagttaaatgtcaaattgtttgaaaaagttggaagaaatgccaggcttaccaaagagggtgagcttttttgccgatatgtgatacagtcactggacatgctggatgaaggaaggcgtgtggtgggtgaagtatccggaatggccggcggatatatcgacatcggatatatttatactctgggaagtcattttatcccacaaaatatgagtgattacatgaaagagaatgagggtaagaatatccgtttttcttttggacagggaaccacagagcagatgatcggggaattgaaaaagggtacctatgatctcgtattttcatcctataaagagggtgaagaccggttgaatttcactcctgttgtggaagaagagcttgtgctgatcacgcccaaaggacatcctctggcaggggaagaggccgttgacctggcaaagacaacgaattatccttacattatgttttcgcgcaaaagcggtctgaggccgtttatcaataaactttttactgaggtaaaagcgcagcctttcatcgcatatgaaggggaggaggattcctctgttgcaggccttgtggccgccgggctcgggatttctattgtgccgagaattcctattctggaaaccatggaggtggaggcaatccccattaaaaggcctgagatcaagagatatatctatctcgttacacagaaggataaatatctctcaccgatcgttgaagactttatagggtttattaaatcccggcaccagatataaaacgatgaggtacggctgagcacaatattgaaagaaatgccggattatggtatactgaaccacattagactacgattgaagaaaagtgaggaacacaatgggaaggttagaagagatcagagaaagactggaagtctgcgacaaacagatcgtgtcggttctggaagaccggatggacattatcaaagagatcatggaatacaaaaaggagaacggacttccgattctgcagccggaacaggaaaagcggcagcgcaaaatgctgaaagagcatgtaaaagagaatacatataaggaagagatccttgatatttttacgtatattgtggaaaacagcaggaaaatccaggcaaggactttgtttacacacaatatctttctgattggatttatgggtgtcggaaagagtacagtatctgactatttaagcaagatccttgcgtcaccgcaggtagagatggatcaggtaatcgttaataaagaacacatgtcgattaacaagatctttgaggagtacggcgaagaatatttcagaaactgcgagaccaaccttctgatcgagctccagaaaaagaataaccagatcgtctcctgcggaggcggagtggcgatgagagagattaatgtccgggagatgaagaagaacggcagggttgttctcctgactgcttcaccggagacgatcctggagcgtgtcaaagacagtgacgaacgtcccctgctcagagggcgcaagaatacggagtacatctcggaactgatggagattcggagaccgaagtatcgcgcggcggcagatatcattgtagatacagatcataaaaatgtcgaagagattgcggaagagatcgttggaaaattaacccatctataaaacaggaggaatgaagatgcaggcatttacccattacacaccgacagagattgtttttggaaaagcttcagaggacagggtggcagagctggcgaagaaatatcacggctccagagtgttcgttgtctatggaggaggaagtgtcgtaaagagcgggctgcttggaagagtgaccgggacactggaagcggcagggctcaaggtggagaccatcggcggagtaaaaccgaatccaagacttgattttgccagagaagctgttcagaaggccgttgaattccaggcagatctgattcttgccgtgggaggcggaagtgtgatcgatactgcgaaggcagtttcgcacggagctgcaaatccggatacggacatatgggagttttggtcccggaaaaagaaagtggaaaaaacactgccggtaggtgtcatcctgactctcgcagccgctggaagtgagaccagtgattcagccgtcctcaccaatacggagatccaggtaaaaagaggtctcagtacggatctgaatcgccctgagtttgccatcatgaatccggaacttacctatacgcttcccaagtatcaggtgggctgcggcattgtcgacattatgatgcatacattggaccgttactttacgaagacaaagggcaatcagctgaccgacgagatcgccgaagggcttcttcggaccgtgatcgccaacggaagaatcgcgatccaggactctcataattatgagagcatgagcgagatcatgtggtgcggaagtatttcacacaacggactgaccggtcttggcgctgagaaagattttgctcctcaccagctgggacatgaactgagcgccaagtttgatatcgcccacggagccagcctttccgccgtttggggagcatgggcagagtattcctacatggaagatgtagaccggtttgtgcgctttgccgataaggtgtggggaatttccggggacaataaagaagaagtggcgagaaaagcgatcaacgctaccgtaaattactttaagttactggatatgccgacctgtttttcagaagccaaagaaatcggccttaagacagaggacgaactgtggacgatggccgacggatgttcctacaaagatacgaggaccattggggcttttcgtgtcttaaataaagaagatatctttaatgtatataaattggcaaataaatagttgataagaagtaccatttattatagaatgttatagaacaaaatgattaaggaggaaattacgatatggtatccgcaggagattttaagaatgggctgaccatcgaatacgaaggcaatatttatcagattattgagtttcagcatgtgaagcctggaaagggagcagccttcgtgcgcgcgaagttaaaaaatatcaagagtgggggtgcgattgaaaagtctttccgtccatctgagaagtttgagaatgctcacatcgaacgaaaagaaatgcagtatttatatacagacggtgaattattccatttcatggatccggagactttcgaccagatcgctctggacccggacaccattggggagtcactgaagtttgtaaaagaaaatatgaacgttactctggtttcacacaacggaacagttttccaggtagaggctcctctgcatgtagaactgctcgtgacggaatgtgaaccgggagaaaaaggaaacacagctcagggcgctacaaagccttgtacggtagagacgggtgcaaatgtcaatgtccctctgtttgtcaaccagggtgatacattgaagattgatacaagaaccggggaatatttatccagggtataagcttgtcaaaaaaccagaagattcgggggatcgtctgcatcatcctgtcggcgttctgctttgcatggatgaatgcatttgtaaagctttccggagatcttccgtcgattgaaaagagctttttcaggaatctggtagccctgatctttgcatttgtgatgatcaaaagaagcggcgccggattccattttcagatcaagaatttacactggtttatcctaaggtccttagcagggaccttaggtattttttgtaatttttatgcggtggatcatctggtgctttcggatgcgtctacgctgaacaaattgtcacctttttttgtcattgtattttcttatctgatcctgagagaaaaaatttccgtattccagttgacttgtatcacatccgcatttatcggcagtatgttcattgtaaaaccaagttttgcatcggtcttggttcttccggcattcatcggatttttaggagggatgttcgcaggatgtgcctatgcctgtgtaagaaagcttggaaccagaggagagagaggaccgttcatcgtgtttttcttctctacattttcctgtataagctgcattccgtttatgattggaacttttcgtccaatttcagggatacagcttgtgtatctgctcctggccggacttgccgcagctggcgggcagttttccatcacggcggcttatacgtatgcgcccggaaaagaaatatccatctatgactatactcagattatcttttcgacacttctcggattctttttgttcgggcaggtgccggatggattcagcatccttgggtatttcattatcatagcggcagcggtcgttatgtttttttacaataaccgcagagaaaaagaagagtaatttcctgtaccggaaatatccttgatttaatattggtgttgcccagtgtgaactgggcaactttttttattttccgatatcatattttttctgtgcatcgtaatgcagcaattcctgctgcctctcatacatccgaaagatatcttccagctgttctatgtatttacgatccgagtgtacatcaaaattatcagggtcgatctcaattccggattcagccatcctgcgcatactccatacataaagtatatcaagggccggtatcagatcttcgccgctttgggtcaggacatattcaaccttcagggggattgtattgtactggatcctgcggatcaatctatcatgcattaattcttttaactgctggcttaataccttctcactgataggaaaatggtttagggtctggttgaaacggatctttccatggtagtgaatgtgatggagtaatgtcattttccattttcctttaatacaatttaaggcaaaatgataggggtttgtacctttttgctccatagaattcctccttgtaatgtttttgtctaattataaggttatgtgtattgtataacactgagaataattttgtaaatgattttgataaaaaaataacggaagtgctggggcaaataaccggaaaagtaagagaatatgcggtgaaaaggtagttactttatggttggcaggtaaccaaatggttactgagtgacagaattgtaagtattgtacgcataaaaatacaatgctatcatcatagatgtcgaaggaaaacagaaaagatgcatctacttcgggttgatttgtgaaaaaagtatcaaaatttagaaaggagatttgaatgatcaaaagaacattagaagaattaaaaacctatgaagcaccgggacattatgggatgactgccatgcgtattcacggaaaagaggaaacaggggcagagaaattctgggtcggattgtcaacattccttccgggcggaggagcagagtatgcctatgaagataatccactggaaaaagtatactatgtgctggaaggtgagatgtctgtccgggattcggacaatcatgaatatatcatccatgcaggagagtctatttcattccctccgaatgaggggcgctatttagagaacagaacaaataacgcagcaaaaatgctggtaatcatcaattacccggaagcatagaagaagcggaggagcatcatggtaaataaagagttcgtaaacaatatgtttgatgtaaaagggaaggttgcaatcatcacaggtgccacaggggctttgggaaaagcggtctgctttggatatggacatgccggaatgaaggtcatggtaaccggaagaaaagaagaaacatgcagagccttatgtgatgaactggaagcagaagggatagaatgcggatattcctgcggagatccggcggttgaggaagatgtcatcaaggtcgtagatgatacggtaaaaaaattcggagaaatcaatgtactggtaacatctgcgggatacaatcatcctcagccgatcattgaacaggatttgtccatgtggaaaaagatcatggattcagatgtacaggggacatggctgttctgtaagtatgtgggcaaagaaatgataaaacagggtaaaggcggaaaagttattttagtatcttctgccagatccaagatgggtatggcaaattatacgggctactgtacagcaaaaggagggattgacctgatggcacagtctcttgcctgtgagtggacagcaaaatataaaatcaatgtcaatacgattaatccgacagtgttccgctcagatcttacagagtggatgtttgacccggacagtgaagtctataaaaatttcctgaaacgtcttccgattggacggctcggggaaccggaggatttcgtagggccatgtattttcctcgcttcatctgccagtgattttatgaccggtgcaaatgtggccacagaaggcggatactgggctaattagaattggaggcagtaaagatgatgatcagaaaagtcgcagtagtcggtgccggaatgatgggaaaagggattgctcaggtctgcaccaacatagaaggcgtaaaagtctgtttatatgatgtgaaggacgtagatatttaccaggatatccagaaggattttgggatgctgggagaaaaaggcatctttacgaaggaagagatggaagaacgagttaaaaggattcatttttcaactgatttggaagatgcagcttcaaatgccgatcttgtatttgaatgtgtatttgaaaatctggaattgaaacaggatattttcagacagttggaggaaatctgcagagaggacacaatctttgctaccaatacctcggtcatgagtcctaccttaatatcaaagaaattacaaaagaaagctcgttttgtaggaacccatttctggaacccggcgtatctgatcccgctggtggaagttgtgatcgcagaggggactgattttgaaactgcgcaggatgtgatcaggtttctgaacgaggctgggaaaaaagctgttttatgcaggaaggatgttcccggattcattgcaaaccgtatgcagcatgcgctttggagagaagcaatctccattgtggaacagggaatagcagatgctgaaacagtggatgaagctgtgaagtacagttttggtctgagacttccgcagttagggcccatcgaaaatgcggatatggtcggtgtcgatctgacatggaatatccacgactatgtactggaatatttagaagattccaaagaaccctctccattattgaaaaatctaaaagaacatggcgatctgggatttaagacaggaaaaggtttcagggaatacacacaggaagagattaatgcttctaaaaatggtttaaatgattatcttatcaaaatgatttatggaaaatagtttcggaggaaaaaattatgggaaaaaaagtatttattgatttaacacatccattcagcgcagagattccaagatggccttattttgataagccggtgattgacagcaaacataccatggcaaaaggaggtgttctgacacagtatatcggatgtacgatgcacacaggcacacattgtgacgctccccgtcatgttatggaagttgagtttgatggcaaaagggcacgctatacccatgaaatgccggtggatgcctatacaggagatgcagtctgccttgaaattaatgtagatcgctggggactgattatgccggaacatctggaggatgcatgtaagcgtgcagatatcaggccagaggaattagagggaatggtggtctgcttaaatacaggaatgcaccgtcagtttgatgattccaaagaatattatcattattcctgcggtacagggattgatgcggggaaatggttcgtggaacacaaagtgaaatgtgtagccatggatatgcaggcactggatcatccgctccatacggcaatgggcaataacggtatgacccgcatgaacttattaggtgcttcaggaaaaccgattacagaagaatacaaggagcagttcggagaagaagcctatgctgagtttgacaaagaagaatacataaggattcatggacaggaagcctacgatgaaaaatttggggagctggaagccatcggatgctggggtacatgggaaccttgccataaaatgctgttaggtcatggaattgtcggtgtagaaaaccttggcggggatctggacaaagtatccggaaaacggttcagatttaattgttttccaatccggtggtacatgggtgacggctccatggcacgctgtgttgcggagattgatgaagatgatctaaatgatgtaccggacagaacttatctgtatggtggaacaggatgcatgaacagataataaacagcaatgagtgaaagccgccaaagcagcggctttcattgggaaaagaaagggattttatggataaaaaaaactctgttataaactttggagtggctggctggggaacgattctttattgtctgtttatgttcttcttttatgtaggtatgatcaatgacggaacgaacgtactggcccctgcggcagcccagaatataggagtgagcccgggaacggtcatccaggcaaatggatatgcaggaatgatcgctgtcataggttttattatcgtagggcagatcaataaaaagattggcgcccgtgcaacttcatcaatttttacgatcatagcaggaatcgcatatatcatctgcggaagtgccacaacgcttcctgtgtatacggcggcaatgattttatgtgcaacggggatgatgtcagcgggctacatagcaggcggtactctggtagccaactggtttccaaagaaaaagggtatcgtgatgggatacacgaccatgggacataactttgcatcagccttttatgtagcaattttaaccgggctggtggcagtctgcggagggatcgccaaaggatgcatccctattgggattgcagcagttatcttaggagtaataggtgctgttttcatcagggatacacctaaggaacggggattgaatccagataatgtgccggatgaggtttacaaaaaagaatatttcacttcaaaagaagattctgaatggactacatcaaaactgctaaaaaccaaagagctttggttagcagctatttttactggaatgttccagatttgttcagtaggcgttatgcaacagctggtcaccagaaacatcagggattttgggatgagccaggccaacgccttatccttgatgacggtagttgcactattaggtgtgttcggttcctggctgatcgggatcattgatgaccggattggaacaaaaaaaacaatgcagggcttcggagtctggtatgcagcggctttggtcatcaatgtaatttctgatgggactacagggattcttttctatatttcaatctttatgatcggatttggaatcggcggtagtgccaatttcacaacttcatttcctacatctatttttggaagacatgggtttgataaggtgaattccgtcatatttccgatacagggctttgtaacagcatggtgcttcctgatcaatgggattgtaacaaatgtcattggcaacctgaactatgcgtacctgatttttgcaggtgcagcattgatcgtttctattgcagtatcatttgtcaatgaatataaattcaacaaggatcacatagtacaggaatcagtaaaagagctttaggaggataggatgagtaaaacaatgatcacggtcgcaaccacaggggcgtggccaacgaaaaaagataatccgaatattcccatgacaccaagggaaatcgcagatgatgtttatgagtgctataaagcaggggcagccatctgccatcttcatatgagagatgatgaaggtaagggaacaatggatactgccaggtttgaagaaaccgtgggatatatccgtgaacagtgcgatattttgataaactgcactacatccggtgatttgaatgcaacagatgaaacaagacaggcacatcttaaggtctgtaagccggatctggcttcgtacgactgcggttccatgaactggatgcacaacagtctgtttcttaaccatcccaggtttttagaggaattaggaatgacgatgcaagaatgtggtgtaaagcctgaaatcgagatttttgatgccgggatgatttacaattccatacattatttaaagaaaggtgtattaaaggctccggctcactatcaatttgtattgggagcagcagggggcagcgccgcaaccgtagaaaatcttgtgtatttgaaaaatctgattcccaaaggttgcacatggggtgcacttggaattggaaaacaacatgtcccgatcatgctggctgcggttgccatgggaggacatctcagagttggaatggaagataatgtatactatggaccgggggaattagccagatcaaatgcccagttagtggagcgtgctgcgaaaatcattaaaacagctgggaatcaggtggcgacaccggaggatgcaaaaaatatattgagtttaaattaagttcaggggagattgccatgaaaaaaagaatcactgcagacaaagcaatggaattcattcatgatggatcggtcctgatgatcggaggatttttgtcaaatggaactcccgaaagactgatggatgcaatcgtgaagaaaggatataaaaatctgacggtcatttctaatgattccggtttgaatgagaaaacagggatcgggaaactgatcagtgcaggacttgtgaaaaaaattataacatctcatattggaaccaatcctgaaacgggaagacaaatgtcagagggaacgctggaagtcacactggtgccccagggaacgctggcagagcggatccgggcaggcggtagcggcttgggcggggtgctgacgccaaccggagtcgggacggaagtggccgaaggaaaagaaacggtcaatatccatggagaagaatatttgttggagctgccattaaaggcagatgtagctttgatcagaggatctgtcgtagatgaagatggaaatatctactatgatggaaccacaaagaatttcaatccgcttatggcacaggcagcagaggttgtgattgcaggtgcagaaaaaatagtatccgcaggagagattaaccccaatcatgtcatgacacctaaaattttggttgattatattgtacaggaaccacaaaaatgcggaggtgtagaatgaatccaaaagaaatcattgcccgcagagctgcacaggaattaaactatggtgatgtggtaaatttagggatcgggctgccaaccatgatttctgattatattacagatgatctggaggttacgctgcagagcgaaaatggaattctgggcatgggaggcgcagcaccgaaaggaagaaaagataaagatgttatcaatgcagggggacagaatgtttctgtgaaatcaggtgcttccttctttgacagcagtacatccttcgggattatccgaggaggacatgtggatataacgattcttggagccttgcaggtggataaagaaggaacactggcaagccatatcgtaccgggtaaaatggtttccggtatgggcggagcgatggatctggtggtaggagcaaaaaaagtgatcattgccatgacccacacggcaaaagggacgccaaagctgctggataaagtgacgctgccgccgactgcggtcaaaaaggtccgcagaatcattacagaattagctgtcattgatgtggaggaagacggatttaagctggttgaaatctctccggaaacaacgatagaagaggtaaagaaactgaccggtgcatatttgaaaatagacagccatttgaaaatcatgaaagtattatgacgggtttgtcaactattttatgaaagtttattgttttttccgggaagggagattctccttcccggaatttttgtattacggtcaagtatcaagctctaaaaggcttagaacgatatatagaaatatggcgagaaaacgacacaggtcatcctccccgcgatgacaccgcttcaactactttcttttttagctaaaggctatattttgccataataagaccgacctccaatcgttagatttttggtctgacttttgggggtcggttcaatttttaatcttggtgcttttttgcgcttctaaataccttgtgcggtacatatattagggttatacagctttacgaagaagggggagtcctatggaaaacacaagtgagatctaccacatactcccgaagtctgtccgggggctgatgcagaaaagcggtctcaagccgagagaacttcaggaaatccggctgcgtatccatcagcctgtgatcgtccgctatgaaaataaagaatattttttgtccactgcagggaagcttacgaccagccatcattttgtacatgttctcacgagagaagagctaaaacagatgatggaatacatcagcaattattctctttatgcctatgaagaccagttaagacaggggtttctgaccgtgaaagggggacaccgggtagggatcgcaggaaaagtgtctattgaggacggcgagatcaagacgatgaagcacatcacttttttgaatatccgtgtggcccatgaggtcattggctgtgcggaggggatatttgaacactgcacgaaagatggacagcttctcccggtgctgatcatttcgcctccggggcgagggaaaacaacgcttttaagggatatgatccgcatggcttccgacggcggcgagactgtgggtgtggtggatgagcgcagtgagattgcggcttcttatatgggagtaccgcagaacaaagtgggcatccgcacagatgtgatggacggatgtccgaagtcggaaggaataatgatgcttgtacgctctatggctccaaatgtgatagcagtagatgaaattggaaaaaaagaggacgtggacgctatgctgtacagtgcttactgcggctgtactttgatggcgacgatccacggcaaagatatggaggaattgaaaaaagtgccgtatgttggggaaatgatcgaaagaaaagtttttaaacgctatgttgtcctgagtgaacaggggaaggcgggaaccgtcaaggagattttggacgaggagggggtgaggctttatggttaaactgctgggtgcggctatagtcattatttccggcggtatccttggattttaccgggcgtcgagggaaagaaagagactggagcaggggattgaattaaaaaggcttttatatcttctgcagggcgagatccgctatggactgacgcctcttcccgatgccatcggcaccatagccgggaagatgaatgccgagttttctgtttttctctctgacgtatcaaaaaaactctcttcttaccaggaagaaacattttctcaagtgtggaagagttctgtcgagaaggatctcataccgtatgtcctggagaaaaagatgctggagccattgatcaccatgggagatacgattggctatctggacaaggacatgcaggtgaagaccattgattttacgattgagcagatcgaggagagaatgtatcagatcaaagaccaggtgatcaagaactgtaaattatatcagagccttggattgtcctttggacttctcgttgtgattattttattgtaaggaggatcttatgagcgtaaacattatctttcggattgcggctgtgggaattctggtcacgatcctggtgcaagtactgaaacactcgggcagggacgaacaggcatttctgatcacccttgcggggctgatccttgtactgtcatgggtaatcccttatatctatgatcttttcgagagtgtacagacactgttcaccatatcttaggaggcgggcctatggttaagatcgcactttttggcatcatagccagtatacttacgttgaaaattaaatccatcaggccggagtacagcctggtgatcggccttgtatccagcctgtttctggcaatctatgcattggacgagatggggaagatcatagacttatttggcgccattgagtcttattcaggaattccgggaacttacatacaaattcttttaaagctggtcgggatttcttttctgtgtgagtttgcctcaaatatatgcaaagatgcgggacaggcaaccatggcaaaacaggtggagatggcgggaaagctgtctatactggttgtcagcctgccgatcctggaatctctgctgacgacattagaaaggctgatgggatgagacaacggatcattttgctggcatttatctttgtgctgatcttcacagcaaaggtgtcagcaaacgaagaggaagatttgagcgaatattcgtttgaacaggtggagaagacattggagaaatcaaacatcagtttctcttatgaggaactggtgaaaaagctgataactggaaatataaaaggcgctttttccatggtcaggcaaagtgtcggggaccagctgtttttgattttgtccgaaaataagaattttatgaaacagctgatcgtagtggcgatcatcgcagcagtgtttaaaaatttttccgatgcattctttcagggaaatacaggagatacagccttttatgtcacttacatgattttgatcggtctgatggcgaattcttttttctttttaaattctatcacggatcaggtgatctctacgctcattgatttcatgaaaggactgatcacggcttactctatcgcagtggtggcaaccacgggagtatccacatcggtggctctgtatgagatgtatctgtttgtgatctatatcatttctcttctggtccagagtgtgatctttccggcggtaaaaatcctgtttgtgttaaagatcgtgaatcacatttcgctggaggagaagctttccaggctctgcgatacactggaatgggcagtgagagccctgttaaaggcactgctggctgtggttctgggaatccagatgatccaggccatgctcctgccggcagtagattccgtaaaagacggtattttaaaaaaaggtgtgtccatgattcctggggtgggacagggcgtcagcacggtgacaacgactctgatcgggtcagctgtcgtgatcaaaaacagcatcggagtggcgggtatttttgttctctgtgtcattattctggttccgctgatgcagatcggcggaattcttctctcttatattgggacaggaattctgcttcagccggtctcagacaaacggatcacagggtctctggatgcggtgatcaagagcggaaaactgctgctcaggacagtgtttactctgagtattttgtttattctgtccatcgccatcgtagccttttccacaaatattaattactatacggggtgacggcatatgcagtatattaaagcgattgttttttttctgattcttatgacactggtaggccagctttgccagggggataaatacaagccctacatccgactggtgaccggttttatgcttctggccctgatgatgagaccgattgcctatgttatgaatataggaccggaagacctggcggtattttccaatgtgaatgctgacagcacagaagcttctttcaggagccaggctcttgagacttataaaagccgcgaagagaagaaaataaaaaaaatccttcaatcctataagatccaggcaaaagaagtggaagtagatacggataatacaaaggatgatccggagatcgatgagatttccgtgaaggttggagatgaagaatccgaagcaaagaaagtaaaaacaatacttttgaacttctataatgtagatgagagtcatatcaatataagtgagtaggaaatgtatgatggacaaaaatgaactgatccaaaaaattgaatctctgggcacaaagaaaattgttttgatctttgttcttggtattgccttgatcgtattttcttttccttcatcagggaagaaaacggccaaaagcaccaaagactcagaaagcaatgagggcgtgtcatccacggatgcctatgtcaaaaagcaggaacaaaggcttgtagcagcgttgaaaaatgtggaaggcgtgggaaaagtaaaagtgatgatcactctgaaatcttcaaaggagtcggtcgtcaacaaggatacaccttatgaagagagcacaaaaaaggacgaaaaaacggtgaaggaagatgaggagaccgttttgattgataaaaacggggagaaggtcccttacatagtgaaggaagtagaacctgaagtggaaggagttgtagtggtcgcacaaggcggaggaagcgatattgtcaaccagaatatcgtcgatgcggtgagtgtgttgtttcacatttcatcttataaaataaaggtgttaaaaatggaggactaggaaatgaagaaaatcgtgaaaaaaaatcagttaatcatcacaactctggctgttattatagcggtcgcgggctatgtaaattatacgggtcagtacattactacaacaaaggacaaagcaaagactgtaagcaacacggcaaaaaatgcctcccagagtcaggcaaaagatgacatcacggatgtgggggaagcagtgctcactaacgcccaggtgggaaattacgtggcaaaggcgaagcttgagagagaacagacccacagcaaggcaaaggacactttggaagaaatcatcaaagacaagacagtcaaggacagtgtcaaacaggatgcggtggataagcttgctaccctggcagaacagatggagatggagacggctaccgaaaaccttctgggcgccaagggatttttaaattccatcgtgaccattcaaaacggaaacgtggatgtcctggtgaacctgaaagatgtctccaaagtggagagaagccagattgaagatatcgttacgagaaagacgggatgcaagctggaaaatgtcgtgatcacatcgataaaaacagaagattaaaggctttgtgtgtaaattccggggacagggatttgcacactttcttttttcttgcataacatcgataagttttggtataattaacatactgtatatgaagaattataaaacagaagaaaaagtttttagaagcaatcagcaggaggctttttatggagaataaaagtagtggttacaagattcaggaaaaagggctgctcggagaagtgaagatcgcggacgaagtgatcgcgatcatcgcgggtcttgcggcgacagaagtcaaaggcgtggcaggcatgtgcggcaatatcaccaacgagcttgtgagcaagctgggcatgaagaagctttccaaaggtgtccgcgtcaacgtggagggaagccatgtcagtgtcgatctggccatcgaactggattatggggtcagcattgcacagatttcaaagaaagtgcaggagaaggtcaagacagccatagaaaatatgacaggcctgaccatcgacgaagtcaacgtaagaattgccggcgtagcgctggaagaagaataatcaaaagatgcggagctgtgaaaagcagttccgttcttactgtgtagagaaaggaccgtatgatgacaaggagtaaattaagagagcagatgttccgtctgtgcttttccatcgattttcacacaagcgaggagtttgaagcgcaggcggacctgtatttcgcaaataatgattttttcaggaacaaagagaaagactacataaagacaaggactctcgatatgctttcccgtcttgaagaaatcgaccaaaggatcaatgaaaacagcaaaggctgggatatcaggagacttggaaaagccgagcttacgattttgagaattgcagtttatgaaataatgtttgatgaggatattccggataaagtggcgatcaacgaggcagtggaactttccaagacctactgcaacgaaaaggccgcctcatttatcaatggggttcttggaaagattggttagatgaataaagtattttcagtagcgcagatcaatgcgtatatcaaaagaatctttcagagcgattatgccctgaaccggatttatatcaagggagaagtctcaaactgcaaataccattcttccgggcacatctacttttcactgaaggatgataaaagtcagatttcctgtgtgatgtttgccaaccagaggataaacgggctggattttgagatggaaaacggtcagacggtcattgtttcgggaagcatcagtgtgtttgagagaaacggcacatatcagctttatgccaacgagatttctctggacgggatcggacggctctatgtggagtttgagaagctgaaagataagctttacaaggaaggcttatttgatcacgaaaagaaaaagcccattccccaaaatcctaaaaccatcggcatcgtgacggcgaagacaggagccgccatccacgatatcatgagtgttgcaaagcggaggaatccatatatacaactcgtgctgtatccggcacaggtccagggcgacggagcagcagatacgatcgtgagaggaattcagactctggaccgttatggggttgatacgatcatcatcggccgcggaggcggatcgatcgaggatctttgggcattcaacgaagagatggtcgccagggccatttatgcggccaaaacgccaattatctctgggacaggccatgaagtggataccaccatcgcagattatgctgcagatctaagggcagccacacccacggcggcgtgtgaacttgcagttccggatttaagggagacgctggatgcgattgacgcaaggaaaagaagtctttctgtacagatccgccatattctgagaaattatgaactccgtctggaacagtacagcggaaaactgcgcagttttgatccgaagcttcaattgcaggagcagaggatgacgcttgcagaattagaagaccgcctgacaaagaggatggattttttgcggaaccgttatcagcatcgccttgaactatatgcacagcggcttcacggcctttcccctacggcaaaactgatcggcggatatggatatttgtcagatcaatccgggcgtccggttgtatcggcgactcagatatccaaaggtgatgaagtacagattaccatctccgacggatctataaaaacaaaagtaacacaagttataccgagagaaaaataaagaacaaaagtgtgctttacacacctcgtgaaccaattttttctatgcacagcttttgttccgcgcgcgaagctgtgcatcctgcccgtagggcttgcccactttgtctttcacaaatgcttagttttcccaacctcaagaactcaaaaaacgtcaaagaaccgcttaaaatgggagtcagaaggagattttaaaggtgatttagcaatttatacaatcggttgggaaaaaatcaaagaaacgttgatttcatcaggaaaactgactataataaaaacaagaaacggcataaaaacgttagataaacagtaacaagagttgtattgaaatagaaaattgcacagcttatgggagacacagaggcggataaacagtaacaagagttgtattgaaatgctgagatagctgacgcataaaaactccccaaaatacgataaacagtaacaagagttgtattgaaatgatttggcttcactggcgataagatcaaggctccagataaacagtaacaagagttgtattgaaatgaaattctatacgctgtattatttccaattgtaatgataaacagtaacaagagttgtaaagtttttctgtcttacagattgtattatgaaacaggaaagcagtaaatttttattaaaatatataagatgagaagacggggagatttatcctgtcttttcttttgttccctgatcaacaggacagattccgaatgattcccattcagtacgtagaatacctcactccagtcatgaagatgtcggacgtaatatctactggataaggaatgcttcaaacaggaggcgccattgtgcaatagtttttcttcactatcggaagaaagcatttcaaaagctgactgaagatagtgaagaaaaactcatgggtttcaattcaaatcaaatatgatataattaagaagatatttttggaaaggaaatcaggttgtcacttatggaaaaaaagaagtttaatattgatgaaggattcagccagttagacgatatattaaagaatttagagcaggaggacgtaaagcttgccgacgcggtagaactttatacaaaaggggtttcgactttaaaagaatgtaaggattctctggaccaggtggaaaaagagctgattattttagaacaaaacggagagaacaatgaatgagtttgatcaggagcttaaaaagcgtataagtcatattgaaggaatactggattattatcttccgaaaccggaaggctttcagaaaacagtgctcaaggcgatgaacacaacggtgaaagccggagggaaacggctgagaccaatgctgatggaagaaaccttcaagatgttcgggggaaagggaaaagttattgaaccctttatggctgcgattgagatgatccatacctattccctgatccatgacgatcttcctgctctggataacgacgactacagaaggggacagaaaacctgtcatatcgtctacggagaggatatggcgatccttgcgggagatgccctgctcaactatgcatttgagactgtttcggctgcgtttgttttagaggatgcagaccttccaaaagtggcagaggccatccggattcttgcccggaaaccgggtatctacggcatgatcggaggacaggtggcagacgtggaactggagggtactgcgcttacgatggagcagatcatgtttattcaccacaacaaaacgtctgccttgattgaagcgtgcatgatgatcggggcggtgcttgccggtgcatcacaggaagatgtaaaagccatggaacaatgcggacggaagatcggtcttgcctttcagatccaggatgacatccttgatatcacaggacagcaggaagtcatcggcaaaccggtgggaagcgatgagaaaaatcagaagaccacatatgtctcgatcaaaggattggaacaggccgggaaggatgtagagaggatctcgctggaggcagtggagattctgagaacctatgatacatctgacggttatctcacaggtctggcagaatacttgattcacagaacctactagatttcaagaagtatgtataaaaaggactgccaaaggagtagacatgttagaacagatcaatcatcccaatgatattaaaaaaatagacagaaaagattaccggattttagccaaagagatccggaaattcctgctgatgaatgtcagcagaacaggaggccatctggcttctaatctgggggcagtggagcttacaatggcacttcacacggttctggattttccgaaagatcagctggtatttgatgtagggcatcagtcgtatatccacaagatcctgacgggcagaaaagacggctttgcttcgctgaggcagttccacggcatgagcggctttccaaaacccacagaaagtgactgcgatgcgttccacagcggacacagttcaacctccatcggcgttgccctgggactggcgcaggccagggatttaaaaggcacagatgaaacaatcgtggcagtgcttggcgacggagcgctttcgggaggcatggcctatgaagcgctgaacaacatggcaaggcttcgggaagaaaagagaaaattaatcgtcatccttaatgacaacaagatgtctatctccgaaaatgtaggcggtatgtccggctacctgaataaagtgcggtccaaaaaagaatatgtagattttaagggaaacgtagaaaaatcattgatgcagatcccggtagtcggagagccgattgccaaaggtctgaaacgttccaaagactccattaagcagctgttcgttccggggatgatgtttgaggatatggggatcacttatatcggccctatcgacggacataatacacctctcctgatcgatacctttgagagggcaaaacagctggatgagccgattattattcatgttgtcacaaagaagggaaagggctaccgctttgcggaaaaggaaccggccagatttcacggagtcgggcctttctctgtgcgtaccggaaagaatctgtccgcacagtcttccggagggccttcctacacggatatttttgcagatactgtgacggaacttgcaaaaaaggatgaaacaatcacggctgtcacggctgcgatgccggagggaaccgggcttgaacgattcaaggaacagtttccggaacggttctttgacgtgggtatcgcagaacagcatgccattgcgttctgtgcgggaatggcggccagaggtctgaaaccggcagcagctgtttattccacatttcttcagagagcttatgaccagattcttcatgatgcggcgatcggaagactgacgatgctgatcggagtagaccgttccgggctcgtaggagccgacggagagacacatcagggtatttttgatgtctcctatctgtcgtcgatcccgaatgtcaccgttatggcaccggtcaacggcagagagttaaaagaaatggtgacctatgcccttacaaagggagaaggtcccatggcggtaaaatacgcgagaggaactgcttccacactgtttgaagaggaatttacgccgatcatgaggggaaagggaagtattctcagacaaggcagtgagatcgcgctactcccgctgggcaatctgatggaagaaggagcaattgtctatgaaaaactcgtaaaagaaggatataagccgacactcgtgaatccaaggtttgtgaagcctctggatgaagaactgatctgttctctcataaaggaacaccgcctgatcgttacaatggaagagggcgtgttaaacggcggattcggacagcaggtaacacagattctggcaaatcatgattacaagggcagggtccggaatatcggaattgacgaccgatttgtggagcatggttctgtaactcagctcaggaaaatgcttggcatcgacagtgatacgatgacagaaaaaatcaaaggttggattggagataaagcatgaaagaacgattagatgttctgctggtgaaaaaggggctggcggcatccagggaaaaagcaaaggcgatcatcatgtcgggtgtagtttttgtagacggacagagggaagacaaggccggcactatggtcaaagaagaacttcccatcgaaataaaaggaaagaccttaaagtatgtcagccgaggaggactgaagctcgaaaaggcaatgaaacagttcgatattcagcttacggacagggtatgcatggatgttggagcgtctactggaggttttactcactgcatgctcttaaacggtgccaaaaaggtatattccgtagacgtggggcatggacagctggactggggcctgagaaatgacgagagggtcgtgtgcatggagagaacaaacatgcgctatgtgacaccggaagacatagaggagccagcgggttttgtctccatcgacgtgtcctttatctccctgaccaaaattcttcccgccgtctatggaattttggaaaacggaggggaagtaaccgctctgatcaaaccacagtttgaagcaggcagagaaaaagtcgggaaaaaaggcgttgtgagagatccggccgtccacgaggaagtcatagaaaaaatcacggattttgccagcagcaatggatttgaactgttacatcttgattactctccgatcaaaggtccggagggaaacatcgaatatcttcttcatatgaagaagaccgaagaaaagcagcacgagaacaacctgagagacgagataccgaaagtggtagcggcatctcacggtgatctggagagggcaaaatagcagaagaaggaagacgatgaagaattttttgattatgaccaatgaagtgaaagacccgggattttccatatccaacaagataagggagtacattgagtcaaaaggcggagccgcttttttgagaaaagattttacggaagatacccagtcctattccaatattcccggggaagtggaatgtgtcattgtactcggcggagacgggacgatgctgcatgcatcccgcctcatagcacctcatgacctcccggtggtgggagtgaatctgggcaccctgggatttttaacggagattgaaatgtctcatctgtcggaggggatcgatgatctgctcaatgaccattttcatatcgaggagaggatgatgctggagggatgtatttaccaccgggacatctcatgctatcggctgtctgccctcaacgacatcgtcattacgagaagcggtttttcacggatcatttcatttaagatcattgtcaacggagatttattagatgtgtatgcggcagacggagtcatcatctcaacccctaccgggtccacgggatataatctctcggcaggaggcccgattgtcaatccggaggcaaatgtcattctgatcacaccggtctgtccccattctctccaggcaaagagcattgtcctcggcgagtgggataccattgagatccatatccagaaggtcagaaaaactcagcttgaggaagcgcttgtaactttcgacggccaggtggcggagcgcctgaatccgggagatatcataaagattcataagtcccggaaagttgctaaggttgtcaaggtgcaggaaaatagtttttatcatacgcttcgggtgaaagttggtgggaaagcatgaaaaaaaagagacagcaggcgatcatcgaactgatcgcaaagcagccggtcgagacacaggaagaactgaccagcctgctgaatggccagggattcagtacgacccaggcgacggtttccagggatatcagggaactggagcttacgaagattcctctgccggacggaaggcaggcatacgggcttttgagtgccagggaaaaagaagtggcaaagtcctatcagagaattttaaatgacgctattgtttccatggagacatccggcaatctgctggtcatcaagacggcttcaggcatggcaatggcctgtgccgcagcgcttgatgatctggatcttcccggactcatggggtccatcgccggagacgacacgattttttgtgccgtaagagagcaggaaaagggcgatgacgtcatcagggagatccgtctgatgatggagagcacaagtgataagtaggtgaattatgttacagagtctgcatgtaaaaaatttagctttgattgatgagatcgagatccattttgacgagcacttaaacatactgaccggtgagacgggggcgggaaagtcgatcattatcggctctattgaaagtgccctggggaaaaaggtttcgagggatatgatcaggccggggagcaatgaggcactgattgaacttttattttacacggaagatgaagaaattttaaacgatttgaaacaaagggaccttcccgcagaggacggcatgatcctggtcaggagggtgatatcggagaagcggaatgtaaaccgcatcaatgactgtacggtgacgttaaagacccttcaggaggtttcagataggctcatgaaccttcatgggcagcaggaacaccagtcccttttaaatgaaaaaaatcacaaatcaattttagaccattttttaagccaaaatgggaaacaatataggaaagacacaaagagaacatttgaggcactgcagaaacttctgaaccgaagaggagattttgaaacagatgaagcccagagactccgggagataagctttttaaaacacgagatccaggaaatagaggaagcacatctcgtaaaaaatgaagatgaacttctggaagaagcttatcaaaaaatgatccacagccaggagattatggagggcgtaaaaaaggcttatgaatgtaccggaaacgaagccgaggtttccgtaggaactctgctttcaagtgccttaaaagagcttcaggggatcgtgaacctggattccgggctgacagattcctacgagcagcttcttcaggcagaagatattattaatgggtttaaccagcaggtctcagaatatatatcgtcaatggaatatgaccctcaggagttctcgaagacagaagacagattaaacctcattaacggactgaaagacaagtatggaaggaccattcaggatgtcttaaactaccggcagcaggctgaggagaaacttataacttatgaacactatgaggaagaaaaagaatgtctcatggagaacatagccaaagccgaaaaggcattttatcaggcggcccaaaagctttcaaaagagcggaaaaaagccgcaaaaatattggaacagcagatttttaaggcgctctcggagcttaattttctctctgtccgctttcagattcaggtatcgggggccgaaggagttcatgccgatgggatcgataaggtatccttcatgatttccacaaatccgggacttccggtgaggcctatcgcggatgtggcatccggcggagaactttccaggatcatgcttgccgtgaaatctgtcctcgcggatgtggaccgtgtaggaacgttgatttttgacgaaatcgacacgggaatcagcggtgagacagccaacaaggttgccaggaaaatggctgtcatcgcaaaagaccatcaggtactggcgatcactcatcttccccagattgcggccatggcagattcacactactatattgaaaaacgtgcagataaaaagaagacgacaacgaccatacaaaagctcacagaggcggattctctcagggaattaagccgtatgatcaacggcgacgatattacggaggccgtcttaaaaaattcagaagaaatgaaaagtttagcaaatgacgcaaaattatactgagtgcttttcttaggtttcagacataataaaaaggatgtatcgcataaaagcgtacgtccttttttaaatcatttatgatttaatctgtttaggaggaaaccatgagaaaatactactaccgcaaacttctcattgctctgtttgtcataaacatcgtaggaatctgtgccgtatatttcaaatactgcagaaatgtactgcccaattctattgagctgaccatgggagaaaaagcctgtttaaagtatgacgtgccggccgtcgggactgtcaaggatcagaagatcaaactgaaccggccgttcgtgctaaccaaagattcggtggggcaggatgagatcaaagcaaagctgttcggcgccatacctttaaaggacattaaggtgaatgtcgtcaaacaaaaaacactggtgcccagcggaaagattgtcggcatctatgtagagaccaatgggatccttgtgctggaaacagatatgatcaccggagtggacggaggaaaccattccccaagctccaataaactatatcagggtgactatattctgtcagtgaatggttcaaaggttgaaacgaaggttgattttatgaaaaagatcaacgaatgcaacggaaaggaagtcaccctggaagtgatccggaaccataaaaaaacaaagattaaagtcaagcctgttcagtctgtcacagacagccagtacaagatcggcgcctgggtcagggataatacacagggcattggaactatgacttatgtggccggaaacgaattcggaggattaggacacggtatctgtgatatggataccggaaagctgatggacatcaagggcggatacctgctgtctccgcagattgacacaattcagaaggggaaatctggatctcctggagaaatagtcggaagcattttttacaaggaggcaaatcttctgggaaccatccgcaagaataccaaatacggtatttacggtacgactcagtcggataagaaagacaaggcttaccgaatcggctataaacaatcagtgaagaaaggtaaagcgcagatcataagctgcatcagcggcaggagagagacctatgacattgagatcaaaagtgtggatcaatccaaccatgatgtgttgaaagggatggagattgagattacagatccaaaactgttaaggctgacgaatggtatcgttcagggaatgagcgggactcctatcattcagaataaccacattataggtgcggtaacccatgtgtttgtggatgattcgacaaaagggtacgcaaccttcattgaaaacatgctgaattcctctaaataagatgattttgctgttatttacaaaaaacttgcgaaggataaggggtgtttgtaaagtttgcaaaaatatataattatattgtaaataaaaacagaatcggaggacttaacatgagcaaaattaatgtggcaatcgcggatgataatcagaaaatggtcagtatgatgactcagcttttaaacttagatcaggagatcgaggtcatcggaagtgccggcaacggggaagctgccgtggagattatcaaagagaaaaagccggacgttgttcttttggatattatcatgccgaagcttgatggaatcggggtgttggaaaagcttcgcgatgagagactagaaaaacagccgacggtgattatggtgactgccatgggtcaggaaagtgttgccgaagaagcgatggagctgggtgcatcttactttatcctcaaaccatttgattcggaaatggtaatccgaaaaataaaacaagcaaaattagacaaaaaagtacagaagccttttgtcgcattaaaggagcaggaaggtctgaataagaaccagctggagatcattatcacaaacattatccatgaaataggtgtgccggctcacattaagggctatcaatatttgagagattcaatcatgctggccatctacgacatggatattctgaactccataacgaaacaactatatccaacaattgccaaacagtttggtactacatctagtagagtggaacgggcgatccgccatgccatcgaggtagcctggggacgcggaaaaatggatacgatcgatgctctgttcggatatacagtccatgcagggaaaggcaaaccgacaaattcagaatttattgcactgattgcagataaaatcagacttgaatacggagatcgaatcgtgtcgcaaaaaatgtctgaaaatgatggaagatagtaaatattgtttgattatgcgattgacaaaggggaatatgcttgatatatttctctcttagaatggttagatttggatggagaggtatacataatgtatgataaacgaaaaattttgatcgccgtcagcagtcaaaatgaggctaaggaactttgcagagaaatggaaaatgaaatgcaggtagtgggagtggcttatgacggtgcttccgcagtaaagctgattaaggaaaatgagcccgatgtggtagtgatcgatattgtccttccggttttagacggactgggtgtgattgaacagtgtaacgggacgatggacgacgacaagataccttcttttattgcaattacctccatcggcaatcagagactgatcgagtgtatcagccttatgggtgtcgactactgtatgatgaagccgtttcatacgaatgtcttaatggacaggatcaatcagatgatgagaatgaaaagagtaaataataactaccaaaagacatttgaggtgaaaagcgagccggtcaaaaaaacgtttacagaatatgatatccagaaagatgtgacaaagatcatcagagatctggggattcctgctcatatcaaaggataccagtacattagggaaggcatcatcatggcgatccatgacgtcaacatgatgaactacataacaaagctgctatacccaacgattgcacagaaatataaaactacttccagcagtgtggaaagagctatccgccacgccattgaagtggcatggagcagaggaaagatcgagctgctggaagagatgttcggatatacgatcagtgccggcaaagggaagccgacaaattctgaattcattgcgctgatcgcagataaactcaggctggaatatcacatgaacgcctcttaaatcaagaggataaccgccagaatgctttatcggttactgttctttgatgcctgagatatccgggacgcacatcatagaataattcgtatggtaaataacaaatccaggctttgctttcggcggttttttcaattccttcctctgtacatagtcgacttctacttttggcgcctgacggccgctggagtaaaaagcggcaagccgcccggcctcttcaaaagtagcatccggcagagtatctgcctgctcttttttcacgatgacgtgagagccaggcatattttttgcgtgaaaccaccagtcgccgccgttggcaaatttaaatgtcagctcatcattctgataattatttttgcctacatacatatggaatccatcggaggacaaaaagtggagaggctttgacttcgtcggttttttagccccttttgaaccgcgctttttcaaatatccataatctgagagttcctgtttgatggaggaaagatcctgttcgttctctgcaagattcagggaagatgcgatcgattccagatgcatcagatcatcctttgtctcaaccgtaagctcggagagagcttcataggtccgtttcagtttattatatttggtaaagtacttctgcgcgttctcctgaggagtcttgaaagggtcaagagggatggtgacttctttattggtgtaatagttcaggcacgtgagggatttggattcaggttcaaggccgtatccatatgcctgaattaattccccatatgttttatatttatctcttttctccgtgtcgagcagctgctttctctgcagatcatattttttgctcgtgcgttcgatggacgtctggacaatttttctcagatcggcagacttctgtttcattctcgcatatttttccttctcagagtaatagatgaccaggacatcgctgatggtgggaaagactttcacttcataagatgtctcataagacgtcatcggaaaacaggaaaattctttcggttccccgttttgataaataatattgggcacatattcgtgtttttccacggaaacagccagttttttcagctgggagtagagaccggagcactggtcctgcgtgagggaatctgtggactggctgccgtcgactccagcgcggtagcagatctcatttgccaaaaacgaactcatgcctgtgatggacgagtaaagtgccttggtgactggtacaggttttggcttgatcccggctaaaaagtcttccagagtcaaagaatctatatcctttttatgctgtgtgggaggcatagagtaagccatgccgggcaggacctgccgtttggagctcatgttggcccccacgtgtcttatgctgtcgaggatcattccgtcctgtcccacgaagattaagttgctgtgcttgcccatcagttcgatgaccagtttcttttggcatacatcgcctaattcgtccagatgttccacggtgatctcgatgatcctctcatagcccggctgttctacggagacgatacggccgttgctcagatgctttcgcagcagcatacaaaagtttggggcctgtatcgggttctgtttgccctgatccgacagatagacgatcggcaggcccggactggcagaaagatggagccttaaattttcccggttctgtttgatcaccagggtgatctcatcggcctcaggctggtaaatcttataaattcttccgtttaatattttttcatttagttcgtttacgatatttgaaatgacaaatccgtcaaatgccatagctgcacctccattttttagttaatcgtattatatcacgccgcgccctgttttggttgattttttgccgttaatgcaggtataatggaaaggtaattttcagaatatggaggaccgagccaatgatagatgaacaaaataaaacatggtcagaccgcagtcatctgctgtggtggccgattacctttacaaaatacagagttgagaaccaaagattatatacgcagacaggacttttgtcaacacatgaggaagaatgcctcttatacagagtcatggatgtctcctatgagaaaactttcggaaaccgcattttcggcaccgggacgatccgccttaccacaagggatgcctcaaacccggtaattgaacttaaaaatattgctgattccagaagggtaaaggatcttctgagccggtggatcgaggaagaacggatcgcaaaacgggttgtgggacgcgatatgtacggcgcaagcagccatatggaggaagatttcgcggacagagatatgtaaaacggttgacaacgaaaagatagactggtatgataactaaagtatttaacatagtagtgaattaccactttagtgtattgaagtgaagaaggagaagaattatgaatcagaagagggtccatacgccggaaggagtaagggatatatacggattggaatgtaaaaagagactcaggttaaaggataaattaaatcatgtatttgccctctacggctatgagaatatcataaccccaacttttgaatttttcgatatatttaacagtgagaaaggaactgtttcctctaaagagatgtacaaattttttgaccgggagggaaataccctggtcctgcggccggacatcacgccttctgtggcacggtgcgtggcaaagtattatgacagtgaggaacggaatctgcggtttgcctataccgggaatgtctttttgaataattccagctatcagctgaaactaaaggaaacctgccagatgggcgcagagctcatcaatgatccttccagccacggagacggagagatcatcgccatggcgctcgactgctgcctgaatgccggactgaaagatttccggctgaccattggccaggtcgagtatttccagggactcgtagagtgtatagaagatgaagacgtaaaagagcagttaagagagctgatcatcaataaaaatttcttcggcctgatcgaatttgtggaaagcctagatattccccaggccgtaaaagatgtttttgtccagttcaatgagctcaacggcgatgtagacattttagataaggccgatgcccttgtgtctaatgagacatcaaagagagccatccggaagctgagaaaagtttaccggatgcttaaggtgtacgggctggagcagtacataagctttgatctgggcatgctgagccgtcataattactacaccggggttatttttaaggcatatacctacggaaccggagacgcagttttaaaaggaggccgttacgacaacctgatcgaacagttcggaaagaaagcaccgtccatcggttttgccatcgtgctagacagcctgatgatggcgctggaacgccagaagatccaaatggaggccgatttcacagacatgctgatcgtctatgaagaggaggccatggaagccgccatcccggcagctgtgggctatcggaaagaaggaaagacagtcatactggaaaagaaggacaggaatctggaagattatatggccatgtcttcggatcaccggatcggatgcgttttgtactatgaaaccggggataccgtcagggatttaatgaaagggcagtgagatgagatatataacatttgcattggcaaaaggaaggcttgccaagaagacattatctttgctggaacagatagggattacctgcgaagagatgaaggatgaaaaaacaagaaaactgatttttgtaaacgaagatctgaagcttaaatttttcctctccaaggccagcgatgtgcctacttacgtggaatacggggcagcagacatcggggtggtcggaaaggatacgatcctggaagaaggacggaatctttacgaggtgctggaccttggattcggtaaatgcaggatgtgcgtttgcgggccgaaagaagccaaaaagtatttaaacggcagtcagctgatccgggtggcgtccaaatatccgaatatcgcgaaagagtatttctataataaaaaactccagaccgtggagatcgtaaagctcaacggttccgtggaactggcaccgatcgtcggcctttcagaggttattgtggatatcgtggagacggggtctacactaagggagaacggactggaagtgctggaagagatctgtccgctctctgcaaggatggtcgtaaaccaggtgagtcagagaatggagcaggagaggatcagtaaaattgtgactgcattaaagaagttgttagacgagaagaaacaggggtagtgccatgagaattgtaaaagtaaatgaagattctattgcggatattttaaacgatctgctgaagagaagcccgaatcactacgaggggtacgaagagcaggtaaatgccatcgtcaatgatgtaaaagccagaggcgatgaggcggtgtttgagtacaccgagaagtttgacggaacaaagcttacggcagacactgtgctggtgacggaggctgagatcgaggaagcgtatgaaaaagtagagccaaagcttcttgacatcatcagaaaggctatcgtcaatatccgggacttccatcaaaagcagaagcagaacagctggtttgacacacaaaagaacggcattttacttggacagaaggtgactccacttgccaggtgcggagtgtatgtgccgggaggaaaggcggtctatccgtcttctgtgctcatgaacgttgtgccggctcatgtggcaggagtgaaagaaatcatcatggtgacacctccgggcagggacggaaaggtcaatccgaatactctggtggcggccaaagaagccggagccgaaaaggtatacaaagcagggggcgcccaggcaatagcggctctggctttcggcacagaatcaatcccgaaggtagacaagatcgtgggaccggggaatatctacgtggctctggcgaaaaaagcagtgtacggcaatgtgagtatcgactccatcgcgggaccgagcgagatcctcgtgctggccgatgacagcgccaatccccggtatgtggccgcggacctgttatcccaggcagaacatgatgagatggccagcgctatcctggtgacgacgagtgagacactggcaaaacaggtttctgaagaagtggatggattcctgaaaaagctctcaagaacggagatcatggaaaaatctctggattctttcggatatattttaatcgccaaagatttaaaagaagcagtggacgcggcaaattctatcgcctcagagcacctggagatcatgatggaaaatccgtttgatgtcatgacaaggatcgaaaacgcgggggcaatctttgtcggacagtacagctgtgagccgctgggagattattttgcaggcccgaaccatgtactccccaccaacggaacagcaaggtttttctcaccactgagtgtggacgattttatcaagaaatccagtgtgatttattattcgagagaggctcttaaaccggtccacaaagatatcgaaacatttgcagagcaggaagaattgacagcccatgccaattctattaaagtgagatttgaaaacgaatagagaaaggaagcaatatgagtcgcagcgcggaaattatccggaacacaagtgaaacgaagattaaactgtttatcgacctggacggcaggggagcctctgaggtggacacagggatcggtttttttgaccacatgctgatcagttttgcaaagcatggtttttttgacctgagagtgaaggtggacggcgacctgcatgtggacagccatcacaccattgaagacacggggatcgttcttggtgaagcgatcaaacaggcggcaggagataaaaagggcatcaaacggtatggctcctttgtactgccgatggacgaaactctcgtgctgtgcggtctggatttatccggaaggccgtattttgacacggaccttagctttactgcggacagggtcggaggatttgacacggagatggtccgggaatttttctatgcggtatcttatgccggtgccatgaatctgcatatcaggcagctctccggcaccaataatcatcatctgatggaggcggcatttaaggcatttgcaaaggcattggacgaggcaaccggtatggacccgcggattgcggatgtgctttccacgaaaggggcattatagatggaacgacagaaaaaaatcattccctgcatttatggggaaaagcttgcagaagcggcaaaggcatacgatcattcaggtgcagatgccgtcagctattacgacgagaaaataactgcggagacagtgaaagagattgcaaaggatattgacatcccgctttatgccggaggaggcattgaagacctggaagacgtgaagaaaattctttatgccggagccgataaggtctgccttggaaaaacagtccttgtggacaaggaaatcgttaaaaaggccggggaccggttcggaaaggatcagatcatcgtgtccgtggatctggaaagccaggaagaaccggtatcatttgcgaaggaaatggcgaggctcggagctggagaactgcttttactggcagacaaagggtatgaaacatttgcatccctgatcaaagaaattaaagaagtatctggccttccggtgatggtgagcatttcagatccgaaagaagctgtccgcatcttagaacttaccggtgccgacgatttggcggtggcatccagagagacgtttggagtcatggaactgaaacacgagtgcagggctgcaaaattcggcgtcaacacatttgaaagttctatgagctttgatgaatttaaattaaacagtgatggaatgctaaccgtggtaactcaggattataagaccaatgaagtgctcatggttgcttatatgacaaaggaagcgtttgaaaagaccgtcgagaccggtatcatgacttattacagccgcagcagaaatgagctgtggaccaagggagatacctcgggacattatcagtatgtaaagtctttgaccattgactgcgacaaagatacacttttggctaaggttgagcaggtggggaatgcctgccatacagggagctattcctgcttttttacggatcttgtaaagaaggaatacaaagatgacaacccgatggaagtgttccagtctgtctacgatgtgattatggaccgcaaaaagcatccgaaggaaggttcctatacgaattatttatttgaaaagggaattgataagatccttaaaaaagtaggggaagaagccacggagatcgtcattgcggcgaaaaatccggatgtggaggaaatgaagtatgagatttctgatttcctgtaccatctgatggtcctgatggcagagcggggtatgacctgggacgaggtgaccagggaattaattgaaagaaaataattgtcattcgctgtccgatttgatataattgccacatgagcaaaccaaagaaccgtggtttgataaaggaggcaggacatgcacgcatatttatcagagtttgtcacatatctgatcaagtttatttttttgcttgccgtatcggtaggaggcgtttttttcggaaagaagatggctgtcggtaagatgcagaagaaagcgcagcagaaagcaaagaatgagcagaaaccggatcaggaataagatgtgtaagatagaatggaaagccttctgatgcagcagaaggtttttctttgctgtaaaggaagctgccaccataggcatctgtccgggcagaatagtttcatattaatttttaggaggatggagatttgaaatcgtatggagtaaatgaattaaggaaaatgttccttgatttttttgagagcaaagatcatttggtgatgaagagtttttctctggtgcctcagaatgataagagtcttttgctgatcaatgcaggtatggccccgttaaagccatattttacaggccaggaagtgcccccgaagaccagagttgcgacctgtcagaagtgtatccgtaccggagatatcgagaatgtcggaaagacagcgcgtcacggaacattttttgagatgctcggaaacttttctttcggggattattttaagaaggaagcaatccgctggtcatgggagtttttgactgaggttgtgggacttgatccggaacgtctgtatccttctgtctatctggatgacgacgaggcattcgagatctgggagaaggaaatcggcattgctcctgagaggatcttccgtttcggaaaagaggacaacttctgggagcacggtgcaggaccatgcggaccgtgttcagagatttattatgaccggggagagaagtacggatgcggaagccctgattgtacggtgggctgtgaatgcgaccgctacatggaagtatggaacaatgtcttcacacagtttgaaaatgacggaaacggcaattacgaagaattagacaataaaaatattgataccggaatggggcttgagcgtctggctgtcgtagtccaggaagtggattctatcttcgatgtggatacgatcaaagcgatccgtgacaggatctgtgaactggcaggcgtgacttatggcgctgatgagaagaatgacatttctatccgagtgattacagaccatatccggtctgcatcctttatgatttccgacggtgtcatgccgtccaatgaaggccgcggatatgtgctgcgccgtctgatccgccgtgcggcaagacacggaaggatgcttggcatgaaggatctgtttttggccggactcagtaagaccgtgatcgcagagtccaaagacggatatccggaactgaaggaaaaagaagaatttatttacaaggttcttacaacagaggaagaacagttcaacaggactatcgaccagggacttcagattcttgcggacatggaagaagccatgtccaaagaaggaaagaaggagcttgcaggaaaggatgcctttaagctctatgatacttatggattccctctggatctgacaaaggagattcttgaggaaaaaggcatttccgtagatgaggaaggattccagaaatccatggaacagcagagaaagcaggcgagagaggcccgggagacgaccaactacatgggagccgacgcaacagtctatgaacagctggaccctgctatgacctctgagtttgtcggatatgattcactgacctgcgaatcagagatcattgccatgacgacggataaagagctgacggactctttagtggaagggcagagaggaacgatcatctgttccaggacgccgttttatgccacaagcggaggacaggaagcggatcagggcgtgatcctgagcgaaaattcctcttttgccgtggaagatgtgattaagctttccggaggaaaattcggacatgtaggatatgtaaatgaaggaaatttaagtgtcggtgagaaggttcttttaaatgtcaatgagagaaaccgccgtcagacagagaagaatcacagtgccacccatcttctgcagaaggcgctgcgcaccgtgctgggaagccatgtagaacaggccggttccagcaacaatgcaaagcatttgaggtttgactttactcatttctctccgatgacaccggaagagatcaaaaaggtggaggatatcgtaaatgaggagatcgctgccagtctgccggtggagacgaagctgatgtctatggacgaggccaagaataccggtgctatggctctgttcggcgagaaatacggggatgaagtgcgtgtcgtttctatgggagatttctctgtggaactctgcggaggtacccatgtttctaacacaggcaccatcactgcattcaagattctttcagagacgggagttgcggccggagtccgaaggatcgaggctatcacagacaaagcggtctttgagtattatgagaagatggaagaagaacttatggaggccgcaaaggttgtaaaatcaaccccgtctaaactgatggtacgcctggaagccctgatggcagagctgaaagaacttcacagcgaaaacgagtctctaaagagcaagttggcgaaagatgctctcggggatgtgatggatcaggtgcaggaagtaaacggagtgaaacttctggcggcaaaagtgaccgatgtggatatgaacggcctgcgcgagctgggtgattccctgaaagaaaaacttggggagggcgtcatagttctggcatcttctctgggcggaaaagtgttccttgtggctatggctaccgacggggcacagaaagccggagcccatgcgggaaatctgatcaaaggcatcgcaggatgtgtcggaggcggcggaggcggccgtccgaatatggcgcaggcaggcggaaagaagccggaaggaatcgatgatgcgatcgcgcaggcgaaggaagaactggccggacagctgaagtaaatagaactaagttaaaaaaccatggacgtgcagcaaagggttgcattccatggtttttactgttatgagcgtatttaaaatataattatagaattagttgaatttgtatgatatctatgacaggacaaaaaactactattttaattgtgctattctaaaaaaagtaaataatttcatatcaataaaaaaggatgattatggaaaaatagtatggtttatttcttgtacatttcttcatagatttgtacgtcgtttgtttattgttttgttcatattttgaaatattgccttgattataatttcctttgtggataacagataaaggaggaatttaacatggcgaaatacgcatatatccgagtttcgagcaaagaccagaatatcgcaagacaggtggaagccatgcaggaaattggactgacgaagaaacagatgtatattgacagacagttgggaaaggattttgaacgcaggaattatcaaaggctggtgaggaaactgaaagcaggcgacgagctttatatcaagtccatagaccgtctgggacgtgattatgatgaaatactggagcaatggcgttacgggaaaatttatagcggatttggtattacagatattttcctacgtcgcccagattgaaaaagaaaacacaaaacaaaggcaggcggagggaatacgtatcgcaaaggaaaaaggcgtacagttcgggcgaccaaaacatgatttcccggaggattttgaagaaatctatcatcacaccacgtttgcgaggtggatagcccgttaccagcaaccaaaggcatagagaaatggcataaaaagtagactttctacaccacttctaaactgttatctttttgtactaggatttaattttggataaaacactattggtttatccaaacttaaatcctagtacaaaaaaacaaagttcagacagcggcacaaaaagtctgctttttgtgccgtgtgtatttctgaccactcaatccttttatcctgatgtgaatatcataatctacattgaggggagggggaaaacgagataacggcaaagcgaagatttcttataatgagaaatcgggagagcgaaccagagaaacaacagctcatggagatgcaggatttgccctgtctggttcaagacctccacaaatatgaaaaatcaaaaaggagagaaataagatgaagcaaaaaaaattgaaaagcctactcgcctgcgtgctcgtcttatgtatggtcattggcgtacagtctaatcttgctttcgcacaggaaaatgatgatactatagtgcaggaaaatgaagctgactatacgacggatatgacagataacactgatacaacagatgatacgactggtgcaacaacggacgacaccaaagatacagacactacaggcaaagatgatgtaaacccggaaacagagagcgaacctacgaatctgaaccgtagtattgctcctactagtctggatgacggttccggcacaggcattgtgccacagtctgatactagcaataacgttactgtaacaattgactctgatagttttagcaaatatagcgatgttatcaatgagattaaatttacaaatacagataacgcccagcaaataactgtttccaaagacgcaaaagtttctttatcagttacttatgctgacaatattcagaatgcagttcttgcatgcgctgcttttgatgctgatggtaactgggtagcggattgccgtgcaggaagtactgattttactgaatattatataaataaaccacaagccgattacaccattcgggtaatcggactgactgaatacaatgttgaaggtgacaccttgactttttccggatctggggaaatatctacttgtggagatgtgatagtaggcaaacaaccgtggaaccaaaacgatgtcagcagggtaattatttctgaggggattactagcgtaggagaccaaacatttaagaatgttaaaaattggagcacgaatacaagcatctccttgcccgacacgctaacagaaatcaaacaatatggctttaacaactgcaatttagcaggctacattagactacctaaaactttaaacagtattggaaagtatggattatccaactttggaaataaggtcatttttaacatgaccgaaaatatcccgacaacctttgtttctaactctttcgctacctacacaggcagtaactctgctgttgtatatgtttctgacaaagcgcaagttgcaaacattggtggtacccataataacctaaatacgaatagcggatatagccacgtatttcttattacagatggggggacttttccagaggatacggtgttttctcttgatgaatatgcagctcctgtaaaatctggatacacttttgatgggtgggaagaaattgacataataaactccccggtaaacaagttggataattccggtcacacttatcaggctaaatggattgaaaaagctgacaactcaattacattcaaaaacccacttaatcttgataggatttatgataaaaccccagtttcattatcaaaagatgattgtatcgtaacaggcgataacagagatgttacattctcttatcaggtcaaagacggtaataattggaatgacattgatactgctccaaaaaatgctggcacatatcgagtgaaagcgactgttgcagaagacgatacttataagagagcggagacagcttggaaagagtttacaatcagcaaggcagacccgacttataaatcaccaactggcttgacggcaactgtcggacagacccttgcagacgtagcacttccagagggctttgcgtggcaggacgctacaacaacttctgttggaagtgctggaacgaatacattcaaagtaacttatacaccagaagatacggataattacaatactgtaaaagatgttgaagttacattgactgtcaaggaaaaagacacacagaagccaacaacagacgataacaagaaaccgtctgcaacggatacagataagaaaccggaaagcacagatacgcagacagcggctaacagccccaagaccggcgacagcacgaatatgacaacgtggcttgcactaatgttcgtatctcttggtctgctggctggcgtattcacagtaaggaaatcacgcaggagcagataaagactgtggggaattttatggacagagatatttttgaggacatgaagattgaaacggggtgtgcttatttttcagatttaccctacatcaaggaaacagtagagaagaaactgcttgaacttcggtttgacctctattccaaagaacagcttcaggaattttgtgactatgtttttcatgacaacggagctgtttatcagtctcttatgatgaaataccgcagggacagcagatacaattagacttgcaggaaaagatatacaactaaatattgctttaatcggctcgtacaaatcacatgttttgtacgggctttttcatttcataggaaagttctacgaccttccctatgaaaaaaaacgctccgcgggttgtgcacagatgcgtaaggaagttatttgcctgcggcaaattgcatctggcacgcaaagttgtcaagcccctcaaagagtgaggggttggggagatgaagtgggcttgcccactttgttctactcccttttctgtatttctaacaatggacaaatattcttgtgattatacttcgttcgaagttttgaattatataattcaaatatctgatgataatcttgccacagctttacgtaagctgtcagagatacactgttttgtgttatctcccatgttggttttattgtcatatcaaggctcattcaatcgtggttaattcgtggtaataaggataattaaagatcgcatataaaattttatttaaataaaaaattcacattgagaatcagggagtaaaaaatagcgtgtgtaagttcaaaaggaacttcacacgctatttttcactcctgacctttaaactgaattattttatcttttctcagtttgaaaagagggctatctaattacgaagaaaaaactcagtacgctttcacagatgtactttttgagtatgctccatatactttctgattcgttgaatcataatagtaatatcttacctgaacgtagtaccgtgcatttttctttaatcctgtttttgtatatacatttttacctaatcccgttgttttgtaagccgcatttttcatgctgctgcttcgggagtagcggaaacggaatgcacgtcttgttccgtctgcttttgtgtaagtctttgattttgctgtgaatccaactcctttgccggatttgccttttacagacaaagcagaagccctgccgacacttaactttgaaaactttgcagtgagtgttacatttaatctgtcatctggaactgttgtcacggtttttccgttgtaggtccatccgacaaactcataaccttttcttccggctgccttatagcttttcttgttccatccgggaagcttacttccggcagttctgtttgataatgtcgtaatggatttgcctttatatccttttaaaatcaggtttgtgttttttgaggattttatgatatcgacttcacagatcggatcactgccctcatcgaaatcaaacgttaaatgttgttttcctacggcaaattggctgaaataattcttgttgattgttacaattttgtctccgacagtataatcttttccgcttgtcaaggtttgggatccgtttttgatgtcttttaaagttcgaccgttattatcaacacctatgacgatatcgccttgtttcgataaatcgaatgtctgaggagtcttaacagatgcatttaccatcggtgttattttgatggttccgagggtgacagcggctactgcattgttaaagtcatttccggcagaagtcacagtaattgtgtaatcaccttccagtagtgtatttaagtcggcctgagtaaaagtaaaggatacctcaccgtttttagtcgctgtggctttctctgtgactttagcaacattgctgttgtcattgatggatgcggttaactcaagagaagctggatttgtatttgaaaagaatgctttgtcaagttttgccttgatctccccatcggctgtttcaaaattgcttcttgattttgtcagcgagatggacttgtcaatggttactgtcggggtttctttattaacaataatagaaccaatcgttgcttctgcaacaggattttcactgtcagttgtagatttagctttaatgtcgtaagtacctgcgggtaatagatttaaatcttcctttgtaaagctaaaatttacttcggtagctgggtctgttgtttttgtttctttggtaataggacctgacttgattgttttttctacggttccaactttgtatgcgattgtagcttccacagttactcctatagccggagttgtatttgaaagagatgcttttacatccttagtctcggaaaattgtgaaacggttcctgtgatagaagcagttcctgaaatagtagtagttggaggtgttgttacatcgtctgcacggattggagttatggtaaatacggtcaccataatcatgcataacattacgctgcatatttgtttcaattttttcatttgtaccttcctttcttttagatgaactagttgtttcataaatctgtatttataaagattaataaatttataattaatactatattaacatatattagaaaaaaatagaatgaaaagctattaaaatactcatgatattgtgattgtataaatagttgattgaaaattaaaagaatgatataatatatgaaaagtttgtggaaccaatttaacgattcggatattaggagaatgttatatgctaaagaaaaagcagcagatctatcagggcagatccgtaaagaaattcaatgaaatccgggatatcttagacatctatcatgtaaaatatacatatcaggtaaaagacaccgtcaatgatactggaagcgactcaccgctgtcctttttaggccggcagcagggaatggcaccgagggcttttaccggaagtgcaggggtagccgcagaagatttaaaaaattattgtatttacgcagttgaagaagaggtaaagacaaaggtgcccgagcatcttcttaaagagatctggaatcctctctaaagtcaactataaaaactcattttttccgttgaaaaacatgattttaactattgacgaatatcccaattatggtataataatctagtgcaagaaagtgcccaaacagtcataatgcacaatataaggctggaggggaggtcaggaattaagaatgtcaaacgttatcgttaaagaaaatgaatctttagacagcgctcttcgcagatttaaaagaaactgtgccaaagcaggtattcagcaggaaatccgcaaaagagagcattacgaaaaaccaagtgttcgtcgtaagaaaaagtctgaagcggctcgtaaaagaaaagtaaaataatagaagcaggcatcgtatacttgaggtatacggtgcttttcttttgcatatattaaaacaacgataggatgcttaagtgtgctgctgcgccaaaaagcatagtgagggtctatatgaagaaaaagccaaaggaggcattagccaaaggtttatcccttccaagagatgtggtctttggcgattttattattaccttaaccggcaatgaacaggtgatgattgaaaattataagggaatcctgtcttacgaagaaaatcaaatcgccgtccagggaaaccacgtggttttgaggatcatagggacaaatcttgtcattcaatattattccatggaaattatgaaggtgaccggcgaaatcacacggctggaatacgcataaaggagaatcaggatggtcagattaatacagtattttttcggaagtatatttttagagatatcaggtccttccgtggaacgttttcttaacctatgtgcaaaacaaaacctggtgctctggaatctgaagccgggtgggaatggatatcagtgttccgtacaaaagagagcctatgaaactgttctggcacttgcagaaaaaaccgggacttcagtccggattctggggagaaaggggcttcccttttttttattggagcaccggaaacgaaaggtgtttttcttcggcatcggcatggccttagtcctgatgtttttaatgtcccagtttatctgggagatcacagtgtcgggaaatgaacggtattccaaaagcgatatgctgaaatatgtaaagagcaatttttatcaaatcgggacgtataagaaaaagattgactgcaacctgttagaggaacatatccgggaagaccacgaaggcattgcatgggtttcctgttccatcaacggcaccagattacatattgacataaaggaatcattggacaggaaaacgaaacaaaatcccagaaagccatgtgatattgtttccaataaaaagggaacaattacttctatgtcagtaaaaagcggcactcctttagtccaggtgggagacaaagtaaaaaggggagatacgctcatttcgggaatgatctattattacagtgacgattatcaggtcaccgagacaagcaagatcaaagccgacgggcaaattattctgagaaccaaagaagattacaaggagaccataccgattgccacttatgagaaaaagtttatatcgaaaagtacgcgggtggaaagtatacagctgttaaactggcagctcaagcttccgatcaaggagcagaaaggggattatgacgtcttaggtgagaagaaactgctgcacatcggtgatctatattttccaatcggcatcacaacaaagaagtttgaaggatacgaacccaaaagaagagttttgacggaagcacaggctcaggataagctgaaaaaacggctctccgcatatgtcaatgacaagaagaaaaagggaattaaagtgataaaaaccaacattcaatatgagagacagggaaatgactacattgccaaggggacgattgatgttgaggagccggttggaaagatcagaaatataaaatctctgacgaaaaaacaggtagaaaaaattacgccgacaaccgctgctccgcagtaattctgtctgctgccgtatgacaaaatgttgaaaagatcggaggcaaatggtaaactactattaatataagaaaataaaatgttgaggagtacctatgaatccaatagaaatagatttggaatttccttctgagcatggaggaaatgtatttggacaatttgatgtttacatgaagaagatcgaaaagactcttcatgtaaacttgattttaagagacggacagctgaaagtggtgggcggcgaagaagctgtgaaaaaagcggagtctgtgatcggggaactgctggaactctccaggagaggcaacattatcacagaacagaatgtcaattacgctttgtccctgtccatggaagaaaaaagcggccatctgctggaactggataaggatgtggtctgccacaccgtccagggaaagcctgtgaaagccaagacactgggacagaaaaaatatctggaacagatctcagagaagatgatcacgtttggaatcggaccggcagggaccggaaagacttatctggcgatggccatggccatcactgcatttaagaatgatgaagtgaaccgcatcatcctcaccaggccggccatagaagccggtgagaagcttggttttcttccgggggatctgcagagcaaggtagatccgtatttaaggccgctctatgacgctctctatgagatcatgggggcagatgcctttatgaagaacatggaaaagggtctgattgaggtagctcctctggcttatatgaggggaaggacactggataattcctacatcgtcctggatgaggcacagaatacgacacccgcccagatgaagatgtttttaaccaggatcggttttggatcaaaggcgatcattaccggtgatctgacccagaaagatctcccgtttgacagtatttcaggcctggaagaagcagtaagagtacttgggaaaattccggatatcggaatatgtaagctgacaaacaaggacgtcgtgcggcaccctctggtacagcagatcgtcacggcatatgataaatatgaagaaagcaaaaaccgaaagaaaaaagagaaaactccccggaaacgaatgaaagacaggtaaagttatgagtgtttttttagagaatgagtatgaaggaacagcaggcatagactgtgaaatgattgccggacaagttattgaggctgctgtggattatgtaacatgcccttttgagtgcgaagtgaatctcatgctcgtgggaaataatgagatccatcggatcaatctggaacaaaggggcattgaccgtcccacggacgttctttcctttccgatggtcgagtacgaaaagcctggatgtttcgacggactggaagaagatccggcagcgtttcacccggattcaggggagctgatgctgggtgatattgtgatttccatggacaaggcaaaggaacaggccgaggcttacggacacagcctggagagagaatatgcctttttgatcgcccacagtatgcttcatctgtttggatatgaccacatggaagatgaagaacgtgcggtgatggaagagaaacaggaagagatcttgcagctggtccactacacgagagattagaggtaactatggggaaaaaacaaaagagcagttttttagtacaaggaaccatattgattgcggctcagatgctttgccgaattattggattactgtatagaagaccattattttctgttattggcgagcagggaatgggatactatggatttgcatatacgatctatagtatggttttactgatagcatcgtttagcattccactggcagtatccaaagcgattgcatcaaggcttgcaatgaaacagtataaaaatgcacagagagtgtttcatggagctttaatatacgcgacagtagttggcggtgcagggttcatcttcacatatgttggggccccttttcttgttccgaatgaggggtctgtctttgcactaaggactatgtcgccaacaatattcttttccggaattttaggtgtactgcggggatatttccaagggcacaatactatggtgcctacctccgtatcacagatcatcgaacaactgcttaatgctgtggtcagcgttgtcatggcatatgtattagttgcgccttatgtaggacatgctacaaaagcagcagcctttaaattggctgaacacggagcagcaggaagtgccataggtactggagcaggtgttttgatcggacttttattctgctttattgtttatttaagttatcgaccaaaagtaaagttacagataaagcacgataaaacaaaaaagaccgaatcctacaaacgaattgtaaagattctgatctttacgatcaccccggtaattttcagtacatttatatataactgcagtgtcagtatagattctactttatttggacatctgctgacgaataaaggattgccggagacaacagtatctgctttttacggcctgttttcaagtcagtataatgtattgatcaatgttcccatcgcgatcgcatcttctttatccaatgccattgtacctgatattgcagggtcttatgcggtcaatgaacaggatgcgatcaaaagaaatattgatacagccgtccggtttatattattgattgctattccatgcgcagttggaattgcagttttagcaaaacctgtgattggactgttgttcggacccaaatatgcagttgagggattgagtccgaggatgctgcaagtcggtgctgtttctattgtattttactgtctgtctactatgacaaacggtatcctgcagggtcttgggaagatgagagttccagtaaaacattcagcaatttcagttgtagccaatgttgcagttttggtacttttaattcagaccacaaatgccaatgtttatgcaatcgttttggcaacggtggctttttcagtcgtcatgagcatgctgaacgcccgggcgctcactaaatttacagggtatagacaggatgtaaaaaaatctgtattaaaacctgttttcagtgctgggatcatgggaattgtaatatttatcatttcctgggtttttgaacagtttatatctggatctagcataggttatgcggcttgcttggctgttgcggtgcctgttggtatgattagttactttatatttgtaattaaatttcaaactttttcagaagaagagttgaaacaaatgccgaagggacatgctattttaagattagctcagaaactaaaattattgtaattgtattgatttataggccttctttcgttatctttattttaattaagatacatgaaatgagggcttctttaaatgtaggagaaaatcttgaaaaaagttttaattacttgcttactgttagcagtatttcttactgcctgtaacaataagaaaacgatacagtctactgaaaagaaacagacacaatcgacagaacaggttgcagaaagcaaaatttcatggaatcagagtccggcggatattaaaaagatgaaagcaaaattgaaaaaatatttgaaggaaaacaagatcaaatttgaatctataaactatgaaaaaaacagctacgataaatatggaatatttccggaagaccagattaatgataaagagaaaaaatatcttcctaatgatgtgtgctattttcttgtttttattcccgaagattcggaaacggctaatcctgccacagctgtatttgtaagaacaaataaaacatggaaattaagcagttattataaaaactaatcatagcccgacaataggattcgtctgtcaatggaatctccaaaaataaattggatggatgtttttgactgatatcggcaataaacgctatggaatcgaaaaaacataatggaatattgccgataatgtggtatactggtacaagaattggatttatgaatagataattatatgatgtgggggatttaaaatggattattattctgtatcacagatggcagacaaatggggaatttctgagcgcagcgtgcggaattattgtgctaatggccgggtacaaggggcctttcttacaggaaaaacatggaatataccagaaaatgcagtgaagccagaacgtaaaaataaaaaaggcaattagccaaaaacacttttagaaatattacagtatgaaaagaagacggaaaaatccgggggtatttatcataagactcagattgatctgacatataactccaatcatattgaaggcagcagactgacccatgatcagacgaggtatatttttgaaacaaatacggttggtattgagaatgagagcctaaatgtagataatatcatcgaaaccgtaaaccatttccgctgaattgattttattatcgaacagtcaaaagcagccttgacagaaaagtttatcaaagagctccattttttgttaaaatcggggaccagtgattccagaaaagactggtttttagttggtgattataaaactctgccaaatgaagtggtcgggatggaaactgttcttcaagaaaatgttcataatgaaatgcaaaaactgttgatgtggtataacagtactataaatataacattagaaacaatgattgaatttcatgtgagatttgagcgtattcatccatttcaagatgggaaggtaacaaggagacaccagcagaaagcggtgtaacagcggcaaactgctttgtatataaatttataggataaaaactaaaggagcatttacaggatcgtgtgtaaatgctcctttagtttttgtgatatttgtcccaatattgacaaaaatgtcccaacatgataagctaaagcatagaaaaatgaggaggagagtgcgtatcatgaagaaaaaaaatgtgataagtttaataaagtattatgtagaaaagaatgatgcgggctttcgaaatgaagcttatgaaattgctaaaggatttgatgcttctggagattatcagctttcggagtatattatgtccttattgtccaatgtgaatacgtttgtaccacagatgtcggagaatacttctcccttttttgaaaaaattgagggaaaggaagaggttctgttacttccagatgtaattaccagtgatttattgggcgtagtaaatgcaattgaacgtcatgttggaattaataagtttttatttcagggagcgccaggaacagggaagacagaggcagttaagcaagttgcacgaatattgaatagagaaatttttatggtggacttttcagcagtgattgatagtaagcttggacagacacaaaagaatttatctatgttattcaaggaaataaatagttttgttcaaccaaataaggtaattgtcatgtttgatgaaatcgatgccttggctttagatcgaacgaatcagaatgatttacgggaaatgggacgcgccacctctgctatgttgaagggattcgatagaatgaatgaaaatgttgttttagttgcaacgacgaatctttataaatattttgacaaagcgttaattagaagatttgattcagttattgattttgatagatatacccaagaagatcttcttacgattgcagagaagatgttagatcaatatcttgataaattaaaactggcaaatagggatatccgcttgttccgtaaaataatgaaactaatgccacagataccatatccgggagaattgaaaaatttgattaaaacgtctatcgcatttagcaatccacgtgatggtatggattattttagaaggctttactatgcagtttgcaatgaaaaaccggaagatttgaaaaaacttcagagtcagaaatttacagttagagaaatagaaatactggttggaaaatcaaaaagtagtgttgcaagagaactgaaagaaggtgtaatgaatgaataacattttacaattaaaaggaaggtttgaacaaaggcctaatggctccaaacctggctcgccgagacttccaaagggaagaagtgtgtcttcgttacatcttattgaattatctgagcaattgaaaagaattttgcaatactggggaaccaatacagatatcaatggtgctttggttagcgtacactatacgcatattgttgcaaagagtaatagactgaaaattttgttgtctgagaatagtaaatcgcctacgaaatctatcagaggagttaagtttatatgggaaccagacgaggatggtaaagagatacaaaagcatgtgtttactcattatgtttcgcttaaaacgattgaaaaagcaatcgtagttttgaatgaaacaatatctgttattgaaaaatactttaatggagatattactagcgaggagacagaaaagatagcagagacgccggcggatagatttcgtgaattttctaaatccaaatttttaaatgctgtggtggatggattttacgttgaaaggtttgatattgatcgcgcaacagaagagataacagaggagtccattatcacaatttatcagacgggcattgaaacaaagaaattgttgtcaaagtttgggattcatattgttgatgaacgtattattgatggcactacgttaagacttaatccagatgaagcgaaactgttatataataacgcttcgtatctgattgcgatgagtgtcactgatttttcccggcttacgagagatgaggtgttagatgataaggaggagcctagtaatgaagaaagcctaatacctcatccgaccaatgaacctgtaataggagttattgacacacaatttaatgaaaaggtgtattttcatgagtgggtggaatataaaaatttacttgatccgaatattcctttgacctcagaagattatgagcatggaacagaagtaagttatattattgtagatggtccgcaaggtaatccgtcacttgatgatgggtgtggcagattccgagtacgacattttggtgttgcaacacataagggttttagttcgtttactgtattgaaaatgatacgaaacattgtcgcctcaaatagagatattaaagtatggaatttatcattgggttccagacttgaaatcaagcctaattttatttctccagaggcagcagaacttgaccgcatacaaagtgaatatgatgttatttttgttgttgcggggacaaatattccatatggtgaaacaaaaaaagatatgagaattggaccgccagcagattcacttaattctctggttgtcaatgccgtagactttagaggaaaatcagcatcttatactagagttggtcctgtattatcctttttccataagcctgatattagctattatggtggaggtggttccagctatatggataaaatggttgtatgtcgtgatgatatgggggcggcatatgtaagcggaacttcatttgcagcaccgtggatttcaagaaaactggcatatttaattcatattatgggattgagtagagaagttgcaaaagcattattgattgatgctgctgcgggatggaataggaaagatgatatttcccatagcattggttatggtgttgttccaaaacatattagtgatattataaaatcttcagatgatgagatacgttttattttgactggtgcatcagaggaatatgagacatatacatataatctgccagtaccagttgtagataatgcacatccattttatgcaagagcaacgttagtatattttccacagtgtgatcgtaatcagggggttgattatacaagcactgaaatggatatacactttggaagggttgttgttgaaaacagaaaagctaaaataaaaccaatagataataaccagcaatcggaagataagctgattaccctttatgaagaagatgcaagaagaatgtatcgaaaatgggataatattaaacatatcagtgaagaaattaaagaaagaagaataccaaggaaagcatatgaatctggtctttggggacttaagataaataccaaagaacgtttgcggagaaaaaaaggacctcttcaatttggtgtagttgtaacattaaaagaaatgaatggagtaaatcgtattgatgactttatcaagatgtgtatgacacgtggctggctggttaatcagttggatatggagaatcagttggatgtatatgcaaaggcagaggaagaaatagtattcgagtaataatgtcgaaaaatgcatatggaagtagaagacatcgtttatttgatgagagaaggtattttaaaagtgttttcgccttgagagtgtgatatatttggaatattttaggattgaaatttttaatgaggtagtatatgagaaaaatggtatattttgatgaaaattctgccacagactatttgactattctcaatggtggcacgttattgatttctgattcagaagaagaaaaggtcggaaacaatactgaaattagagctggtgcaaggctaaaagttctatttaattctttgtttgttagcggaagtgcaaacttagactctaatataggagcctacacatcaggagaaaattttataaaaacaacgatttcaaatacgacactctcagattttatagaggttgtaagggagtcggacagtgacattaaatgtatgaatggatatagcatatatattatgcctaactctattgcatattttcagacaattactccttatttagcaatgacagaggggaagatttgtgttgatggagattttgcaatcaatatgaataaaatgtatgatacattgcgtttgggaaagggatattatgaactgttagcaataaaggaaacggaaaaggcaatattccgctttaacaatgaagcatttaagaacaactatgggatttctgatttattacagatgaatttgaacttttatggtgttgaagtgggaaagggaaaagaagatcagtttgatttttcaaagatgttttctgatgaaggaaaaattataactgattttgagcaggttgtggcagagaacaatgaggacaaatcgttgcctatttatgatattatattggcaggagttgaatagatggcaaaatttgtattatattatggacctcgtaatgagttttcgaaaattattccagaaagatattaccctttggaaactttggttaaggtctgcgattcggaaaatgtatttagaaaagtagattttgattatgtagtaggatattcgatgtcatattcgagcatcacggagggaggtattcagaatttctgtactattttggatcgagtggatgatactttggagattgtatatttgcagaatccaccagaatgtattaaggatgaaattattcgatcccatagcaaagagaatgtaaagataaagcaatacaaatataggtcgataggaaagaaacagttagagagcattaatattcattttgatgaggagataatagggcaacctaaagtgaaaaaacaattattggcttcgttgtacgagttatatcgtaagaagaataagaatgcaccaatcatttttatgttctatgggccttcgggtgttgggaagacagagacagctaaatatttgagtatgcttcttggtggagaattgtttaggcaacaattatctatgtatcagacgcaaggtttttttgattatttatatggtgctgatcataacagaggaagttttgcaaaggacttattagaacgaaaaagtaatgtggttttattggatgagtttgataaagcaaatccaggtatatggagtgcgttttatcagatgtttgatgaaggtcattacatggataaaaattatgatgttgatttgaggaatgtaatttttatatgtacatctaacgagccttcaccagaaacaatacgcaaaaaaataggagatccactgtattatagagtgaataggtacattgagtttcaacttttggaccttattgcaaaaaagaaaatggtgtctaagattgttcatgaagagtattcgcggctgacaagagaagaaaaggcaaaaatgaatgagaaagacttagaagataaatatcttgttggagtggatgtttttcagaattttagacatgctcgaaacttgataaaaaatgatatcaatcaggcgttagtggaagattttttgagataaatcaccggatattacaagagtattttatcgtgcaggatatatcgaaagctggggatgtggcattctgaaaatttaggatgcctgcaaaaattttggagtggacgctccggagtatattgttcatggagaagatattatggtgaaatttactgttcttcaaaatcctaaagtatcagattccaaagcccctaatgtcacaaaagatgtctcaatagaagtaaaaatattagcgctacttatagaaaagggaaaaatagaacgtaagggtggcgaaagatacggctattggggaatttataaatagcttttaatccctatcgttccatttccagatgaaaatggacgagtgggcaggctgattctttttaaagaatgtttaaaacataatattgtaccgtttattatcagtgatgacctaaagatgttttattaccgcggtctgaaggaatggaatcatgaaaaaggctttttgaacgatacttgtctaacggcacaggatcggtataaatcatatttagattactttagaataggatactaaaagattaaaatttccagataccggaaataaattcgtattttctttacaattttgataattaattataatctgtttacttttctgctataatataagaaaaagcggaggatagggcatgaatcaaatattagaacagacggcagcaaggagaggcggattggaacgctgtatctccacaagaaaagaagtcacgggaggattataaagaaggatcatcagtcctgtatggaggcacttttgagatatgccaaggaacagagactgctcgtgagtttttatatggatgaagacagaagatattccatcctcggatccgtcctggatttcagcaagaattttgtcaaagtccaaaagattaataccgatggttttgaagacggttttgtgtatctggatattcagaaagtaatttcctgccgatgtgatacggcaaaagaacaggatattttgctgctgaatcatgtaaattgctaaatttgattttttttgaatagaacggctgattttgggaacgcttatggaaaaggagtgtttcgtatgaacaaaatcaaccgttttttattaatatatatggtcgtgatcacaaccctctgcgggtatatgtgttatgtggcgttttatcagaaggataccagccaggacaagctggtccatcaggtgcagtccacaatcatcaaagaacagacgacaaaagagcaggcagagacttctaaaaagaaaaagacaacctacgggctcgccctgcgcgacggcagtctggtgatcttgaacaatcagacaaaagaaatttttgaatatacagatttaacaaaaaatgatctgccggatgaagtccaccagatgctgaaagagaaaaagaaatttcattccgtggaagaagtgtatcatttccttgagtcttacagcagttagcactataatctaaagagaagataaaattctgaacaagatagattgaggtgaccggaatgaagagagtttttttgatcgtgctggacagcttcggcatcggggaagcgccggatgcgaaagatttcggggatgaggcaagcaacacgctgctggcagtgtccaaaagcctgtactttgacctgccgaatctggagaaactggggttatttgctgttgacggcgcagagattgacggtgacaggcagataactgcgccgattggcagctacggacgcatgacagaacagtcgaagggaaaagatactaccatcggacattgggagatcgcggggatcatatctgaaaaaccgctgccggtgtatccggaaggatttccggaagaagtcactgcgctttttgaacaggaaacaggtagaaagatcctttgcaatcggccgtattccggtacggaggttataagggattacggagatgagcacgtgaagaccggagcgctcattgtctatacatcggcggacagtgtattccagattgcggctcatgaagatgtggtgccgccggaagaattatacaggtactgtaagactgcaagaaagatactgactggaaaacacggcgtgggcagggtcattgcgcgtccgtttacaggggagagcggccattataccaggacatccaaccggcatgatttctctatagaaccgccaaaagtgactatgttggatcagctgaaagaaaagggatttgatgtgatcggtattggaaagatccatgatatttttgccggaaaagggctgactgagttttcgtttacgaaaaacaatgaggatggcattgagcagacgaaagaatggatgaagaagaggtttgaaggattatgcttcgtgaatctcgtagactttgacatgctgtacgggcaccgaaacgatgtggacggatatgccaaagctctcagctattttgataaacagctgccaaagcttctggggctgatgaaggagggggatgtactgatgatcacggcagaccacggatgtgatccgtcgactccttccacggatcattccagggaatatacgccgtttctcatgtatcaatatgggcagacaaaaggtgtcaatttaaaaacaagaaaaacatttgcagatatcgggagcactgtgttagactattttggtgtagagtcaaaattagacggaaccagtgttttggaggatatagatgaaatatgatgtaatcatcgtaggaggcggggcatccggcatgacggcggctatcacagcggcgcgcagaggatgctccgtccttgtgctggaacggatggacaagccggggaaaaagatccttgccacaggcaacggacggtgtaacctgacaaacagttacttggaccaggactgttaccggggagaaaaaccgggattcccatattctatgctggaggtgttcggggcggcagagaccctggatttttttcagtccatggggatgctgaccaccaacttgggaggatattattatcctgcgtccatgcaggcttccacagtcgttgatacactgacaggagaaatgagacagctcggcgtacatatgaagacagggacggaagtcaaaaggattcagaagaaaaaggatacatttcatgtaacgtgcggcacagataagtatcagggcaggaatatcatcctggcagccgggggaacggcccaggaaaaactggggagcaacggcagcggatatgctctggcaaaagctatgggacatactgttacggatatttttccggctctggcggctctggaatcaggggaaaagttctttaaacatctggccggcgtccgcagtgtctgcgctctttcggtttatgtgaacggccaaaagaccgcagaacaaaaaggagaggtccagtttgccaaatacggaatatccggaattccggtatttcaaatcagtcggtatgccatcgatgctctgaggaagaagaaaaaggtggaggtgatcttaaacctcatgccggagcagattacattgaaggaattaatggactatttcagaaaagtcggatattacaagacagcggaagaatttctccagggcttcctgaataaaaaactggcatttacggtactgagccgtataaagatccggccggagaggagtgcagcagaccttacacagaaagaactgaggcagatccgctccatgatacagaagtttccggtcccggtttcggggtataaagggttcgatatggcacaggtgacggcaggcggcgtctctgtcagggaagtcatcgagggtacactggaatccaagatccatcgggggctgtactttgccggggaattgctggatgtagacggcacctgtggcggatataatcttcagtgggcttttacatcaggatatatttcgggaaatcagatagaggcggggaatcaatgatcagaatcagtcagataaaacttccggcggaacatacgaaggtccagctggaacagaaaataaagaaagcggtacatcacgcaccgttaaaaagctatcagatctttaagcggtctttggatgccagaaaaaaagaccagatcagctatgtatatacaatcgatgcagaaatagagagagaatccgtgtttctcaaaagaaacaaaaatcccaggataacgaaggccgaaagaaaagaataccggttacccaggtgcagaaaggaaataccggtccgccctgtggtgatcggcatgggtccggccggcctttttgccgccctggttctggcaaaagccgggttaaaaccgattcttctggagcgagggaaacccgtggaagagagaatgaaggacgtagaggctttctgggaaagcggaaatctcaaccctgagtcaaacgtacagttcggagaaggaggggccggaaccttttctgatggaaaactcaatacggcagtgaaggacaaatacgggcggaaccggtttgtgctggagacctttgttaaatacggggcaccggaagaaatcttatatgacggaaagccgcatatcgggacagacctgctctgtaaggttgtggcaaatatgagaaatgccatacaggaagcaggaggaacgattcggtttgaaaacaaggtaacagatttagtaataaaagaaggcagaatgactgcgcttgtgatcaatgaaacagagacacttccctgcgataccgcagtactggcggtaggacacagtgccagagatacctttgaaatgctgtacgaaaataagctgtatatgatgccgaaatcttttgctatcggggtaagggtggagcatctgaggcagaagattgacgaatcccagtatggaaaaggggcgggggacaaaaaactgcccacggcttcctataaacttacttacagggcttcaggcggcaggagtgtctattctttctgtatgtgccccggaggatttgtagtgaatgcgtcttcagaaaaaggaaggctgacagtcaacggcatgagcaatcacgaccgtatggcgagaaattcaaacagcgcgatcattgccagtgtaacgccggaagattttggatcggaacatccgctggctggcatcgaattccagagaaagtgggaggagaaagcttaccgggccggaaacggagcgatacccgttcagacgttttcagattttaaggaagataaaaagagtgataaattcggaagagtccttcccaatacaaaagggaaaacagcattcgcaaatataagggaatgtctgccggatgagatttcagaggcaatcatcgagggaatggatgcctttgagaaaaaaatcaaaggattttctgatggtgatacagtcctgagcggaattgaggcgagaacctcatctcctctccggatggaaagggatgagtcatttcagggcagtattcccgggatctatccatgcggggaaggcgcaggatatgccggaggaatcacgtctgcggctatggacggcatcaaaacggccgaacaattaatcgaaaatatggataaaaaatacaacatattgtgatgtttaacatctggacacacaatatatattggtttataatagaggacagaataattgaaagggtgaagataaatgaaagtgattaagagaaatggcagtaaagtagattttgatccgtctaaaatcgaacttgccatcttaaaagctatgaggtacggaagcggggttgtagatgaaaaatgtgcaaaggatatttcctttgagatccatgaggaacatcagggagacgaggatatcagcatttaccggatcgaagaccaggtatttgaaaagctcattcaaaaagaccagattttgacggcgaaggcctatgaaggataccgtaaggtcagagagttccagagagagacgaataccattgacaatgaggtattcggcatcgtgaccggagaaaaccaggaagctttggatgaaaactctaataaagatccgaatatcctggcaacacagagggatctgatcgcaggggaattttccagggattactgcaggaggatgatgcttccgcctaaaattgtccaggcacatgatgacggcatcattcattttcacgatatggactactatatccagcagatgcataactgtgacttggtggatttaaaggatatgtttaaaaacggaacggtgataaacggtaaactgattgaaactccgaagtccctccagactgcttgtacggttgcgacccagattgtacagcaggtggcaaacggtcagtatggaggccagacgatttcgctttcccatttggcaccctttgtaagagtgagcttagataaacataaagaaaaggtgaaaaaggaaggggagatgatcggaaaagagtatacggaacgggaagtagaactgatcgcagaagaccgtcttcacgatgagatcgtttccggcatccagacgatacagtatcagatcaataccttttcaactaccaatggacaggctccgtttttgtctgtcttcatgtacatcagtgaagaaccggaatatgaaaaagagacggcgatgctgatcgaagaaatgttaaggcagcggtatgagggaatgaaaaatccggtgggagcctatgtgacaccggcatttccaaaacttttgtatgtcttggataaaaacaacgtaccgaaagacagcaggtaccgctatctgacggatctggcggtcaaatgtgtggcaaaacgcatgatgcccgactttatttcggcaaagatcatgaagaagaattacaaaggggaagtgttcccgtgtatgggatgccgaagctttctggccccatggaaagatgaagaaggcaattataaatggtacggcagatttaatcagggagtcgtgactattaacctggccgatgtgggattgtctgcggagcaggatatggagaaattctggaatatcctcgacgaacgcctgagcctgtgccgggaagcgctgatgctgcggcatgagagcctgaaaggtaccttgtcagatgtgagtccgatccactggcagttcggagccatcgcaaggctgaagccgggcgaaacgatcgataagcttttggaaggcggctactctacactttcccttggatacatcggtttgtacgagtgtgttctttccctcctcggaaaaagtcatacgacggaggaaggcgatgaactggctgtcaggatcatggagcgtctccggggagcatgtgaccggtggaaggcagagtccggacttggattcagcgtgtacggaactccggcagagtctacgacttatacgtttgcaagaagcttaaagaaacggtttggtgttgtggaaggaatcacggataaagattatattacaaattcttaccatgtaaacgtgactgaaccgatcgatgcctttgaaaaacttggatttgaagcaaagttccagagcatttcttcaggcggggcgatcagttacgtggaggtaacgaacctgaatcagaatctcgaagcgctgtctgctctgattgactatatgtacgataccattcagtatgccgagatcaatacaaagtcagactactgtcaggaatgcggatttgacggggaaatccttcttgatgagaactatgagtggtactgtccgaactgcggcaacagaagccacaagactttaaacgtatgccgcaggacctgcggatatctgggagataatttctggaacaagggacgtacccaggagatcggagaacggtttgtccatctggataaccaggtgcaagaggtgaactaaatgcggtacgcacagatcaggaagatcgatatttccaatggagtcggcatcaggacctctctgtttgtacaggggtgcacgaggaagtgtaagggttgttttaacccggaaacatgggattttgagggcggccttaaatggaataaagaaacggaagaagaatttttaacactgacagcaggagagcatatagccggggcaacgattcttggaggagagcctatggagcctgcaaaccggcgtccggtcagggaattgctgatgaaactcaaagagcgttgtccggaaaaaaatatctggatgtattcttcttatctgtttgaagaaatcatggagtttgatccggaggtgcttcaatatctggatgttttagtggacggcccttttgtggaagaaaaaaaggatttaaatttaagattccggggaagcagtaatcaaagagtcattgacgtgaaagcatcactggaaagtgaagatgtaatccttcttgatgtttagttaaaaacccagaagaattctgatatagtcagattcttctgggtttttaactaaatcaatttttcgtgtcgatttttcggtgataatacgttgatttttttttagaaagaggctacaataatcataaactgcgctgaccgaggctcagcgggaataggacaggacttcagcattatggaaaacagagaaaaactaaaggataagaagcggatcgtagttaaggtagggacttcttccctgatacatccgaagacaggacagctaaatttattccggcttgaaaagctggtccgtgtcctgacagatattcacaacagcggaaaagatgtgatattagtatcgtccggagcgatcggggtcggctataaagcactgggactaaaggaacgcccgggatctcttccgatgaagcaggcctgctctgccgtgggacagggacagttgatgatgatctatcaaaagctatttgctgaatacaatcagggctctgcccagatcctcatcacaaaagagacgatgttgaacgatatgcgcaggttcaatgcaagaaatacatttaaccagctgctgagtctgggcatcattcctatcgtaaatgaaaatgacaccgtctccacagaagaaattgagttcggagacaatgacactttatctgccgtggtcactgcggtagtagaaggagatcttttgattcttctcacggatatagacggattatatacggacgacccgcataaaaataaaagagcaagacttatatcagaagtacccgtgattaccgaagagatcgaaaacatggcaaaaggagctgtgaccaaggtgggaaccgggggcatggccacaaagatcgcagctgcaaatattgtgacagactgcggggccgatatggtcatagcaaacagcagagatttaaatgacctgaacagaattatcgggggcagggagatcggaacgcttttcttagcccataaaagagaacattttaattttcggaaatatcttacggaatgtccgtatttaaactcataattttgactggaaaggaatagtatgaacgaagacaagatcagaagaatcaatgaattatatcatctggaaaagtccatcgggctttcagagaaggaaaagaaggagcagaaaaagctgagagaagaatatatccagtctgtccgggcaaatctgcgcggacagctgaatcatatcagcataaagaatgaggacggaagtgtgactccgctgaagccaaagggaaagcactgagataaagatagaagggaggttgttatgttagaacaattaggaagacaggcaaaagaagcgtcggtcgttctggcgcaggcgcctatgaatgacaaaaacgagctgctcagggaagcggcagaccagcttgtgacaaaccagaattacattctttcggagaatgtaaaagacgtgaaagcagccatggagcgcgggatgtcggaggcactggtggaccgtctgactctgacggttgacaggatcgaaggcatggcagaaggactcagacaggtggcggacttggaagatcccatcggggcagtcaccgagatgaagcccaataaaagcggactgctgatcggaaagaaggtcgtgcctttgggcgttgtggggattatctatgaatcccgtcccaatgtcactgcggatgcgtttgctctttgctttaagacaggaaacgcctgcctgctccgcggcggaagcgacgccatacattctaatcttgcgattactaaagttctccaggaatcattagccaagaaaaagatgccggtattcggcattcagctcctggaagataccagccggaaaactgccacaaagatgatgcagatgaatgaatatattgatgtcctcattccaagaggcggagccggattgatccggagtgtcgtgaaaaacagcacggttcccgtgatcgagacaggaaccggaaactgccatacttatatcgatgagtatgcagatccccaaatggctgtcgatatcgtggtcaatgcaaaaactcagaggcttggaacctgcaatacatgcgagtctctggtcatacataaagatgttgtacagacccatcttccggctgtcgtagaggcattgctgaaaaagggagtgcaggtcagaggagacgagagagtcatggcagtcagtgaccaggttatccgggcgacggaagaagactggggaaccgaatatctggatgccgttatctcggtaaaggtcgtggacagttttgatgaggcggtaaaacatatcaaccgctacaataccaaacattccgaggcgattgtcacagattcttattcccatgcccaggagtttctggagaagatcgatgcggctgcagtctatgtaaatgcttccacgagatttaccgatggattcgagttcggctttggagccgagatcggaatcagcacccaaaagatccatgcaaggggaccgatgggactcgatgcgctgacgactaccaaatttattatttatggcaatggacagatcaggcattagataaaacttcaaagagggagttctcaggatcggggactccttttagattgataattaattcacatatagaaagcactattgtttctttttctgtgcaaaaagatgaaaaaagtaaaagaatgaaaagattttagtgatatgtgtgttattttgtgggatttcatttgtgaaaaaaatgtcgaaagttgattttgcatgctaaacaatttatcattaaagatatggaaattaaagaaaagagaaaggaaggcttaaaaatggcattgtttacatttagcggcggagttcatccggatgacgggaaagaatacgcaaaaaattctccgatcaccgaatatctgcctaaaggagatgttgttttacctgtcggccagcatatcggggcacctgcgaaaccgatcgtacaaaaaggtgatcaggtactggcgggacagaagattgcagaggcaggcggttttgtgtctgccaatatttacagctctgtttcgggtacggtgaaagcaatcgagccgagagtgactcccgccggggcaaaagtaaatgcaattgtaatagaaaacgacggagaatttaaagaagcggagtttaaagcaaagccgtatcaggatatgaccagagacgaggttctcgctgcgatcaaagacgcagggatcgtcgggctcggaggggcaggtttcccgactcatgtgaagctggctccgaaagatccggatgccatcgagtacatcattgtcaatggtgcggagtgtgagccttacataaccggagattacaggatcatgatggagactccggaagtcctcgtggaaggtcttaacattgttcttgacttgttcccgaaggcaaaagggatcatcgcagtggaagacaataaaaaagatgccattgccaaagtcagcgattgtgtcaaaggagatgcaagaatttcggttgcagagttaaagacaaaatatccgcagggagcggagcgttccctgatctatgcgactacgggaagagccatcaattccagtatgcttccggcagatgcaggatgtattgtggacaacgtggcaacgattgttgctgtcaaggaagcggtaaaagagggaagacctttgttccgccgtgtggtaacggtgaccggagatgcggttgagagccctaaaaaccttttagtccgcacgggaaccaacgtcaacgaactgatcgaagcggccggtggatttaagggacagcctgaaaaggtgatctccggaggtccgatgatgggaatggccatgtttactaccgacgttccggctgtcaaaacattttcttctctgcttgcatttacaaaggaccctgtgtctgccgtagagccgagcaactgtatcaactgcgggcgctgtgtcagcgtctgtcctcagaagttaatgccggcgagactgtccgtactggcagataacaataactttgaagcatttgaggcactccacggagatgagtgtgtggaatgcggatgctgttcttttatctgtccggcgaagagaaacctggcacagtcaatgaagacaggacgcaaacaggtcttggcaaatcgtagaaagaagtaaaggagaggtacatatgaacgaaacattatatcgtgtttcagcaaacccgcacgtaagggacaaaagctcaacacaaagcattatgctggacgtaatccttgcattactcccggccacagtttttggtatctatatcttcggtgcatctgcggctgtgaccattgcggtctccattgtcacctgtgtggctgctgagtatatatatcagaagctaatgaaacaaaaagtatccgtcagcgatctgagcgcggctgtgaccggactcctgcttgcgctgaacctgccggcaggtgttcctttctggatgccggtgctcggcggcctttttgctattattgtcgtaaaacaagttttcggcggcctggggcagaattttatgaacccggcattgggagcccgctgttttctgatgatctcttttgcggcaagaatgacgacatttacctatgacggtgtcaccaccgcgactcctcttgccctgctgaaagcaggaaagagtgtagacctcggaaatgtctttacaggatttatcccgggaacgatcggagagacatccgccgtccttctcctcctgggaggagcctacctggtattaaagaaagtgatctcaccgctgatcccatgcatctatgtggcgacggtggctgtcttcgtactgctttttggaggacatggcttcgatctcacttacatggcgtctgagattttttccggcggtttgatgctcggtgcgatcttcatggcaacggactatgtaacttcaccgatcacttccagaggaaagatcatcttcggcgtcctctgcggactgctgaccggtattttccgactgttcggaccgatggcagagggagtttcttactctattatcattgcgaacctggttgttcctctgattgaaaagattacggttcctactccgtttggaattgtgaaggcaaaaggaggcaaagacaatgaataaaagtttagtaaacgactgtattaaattatttatcatcactctggctgccggactgatccttggattcgtttacaacgtgaccaaagatccgattgcaaagcaggaagaaaagacaaaacaggaagcatacaaggctgtgttcaaagacgcagatcgatttgaggcagtgaagcttaataaaaaagagataaacaaagttttgaaggcaaagaatttgggccagaatacggtcagtgagattgccaaagcagtagataaggacggaaaaggtcttggatatgtattctccgtgacaaaccctgacgggtacggcggagatatcaccctctccgtcggtgtcaagaatgacggtacggtcaacggatatgagactttgacgatcagtgagaccgcaggtcttggtatgaaggcaaaagaagatgaatttaagagtaacttcaaagataaaaaagcgaagcagtttgaagtcgtaaaagacggttccggcaagaacgacgacgcaaaggtcgatgccatcagcggtgccacgatcaccagccgtgcggtaacaagcggggtcaacagctgtgttgctttaatggatacattgaaaggaggtaattgagatgaaaagtaatccgatagaacgtttaatcaacggtattgtcaaagaaaatcctactttcgtcttaatgctcggtatgtgtcctaccctcgcggtaaccacatccgccatcaacggggcaggaatgggactttccactacggccgtgttaatgttttccaatctgatcattggactcatgcgaaatattattcctgacagggtccgtattccgggctatattgttatcattgcatctctggtaacggtagtacagttccttttgcagggatatgtgccgtcactgaatgcaagccttggaatatacattcctctgatcgtagtaaactgtatcatcctgggacgcgcagaatcctttgcatctaagaacggggcagttctctctttcttcgacggtgtcggaatgggactgggatttaccattgcactgactgtgatcggagctttccgtgaactcctcggtgcaggtacgatctttggcacaaagatcatgccggctgcttatgagccgatcacgatctttatcctggcccccggagcattctttgtcctggcctgccttgttgcagttcagaataaggtaagaaacaagaaaccgaaaaaagcaggagagcctcaggcttccggctgcggcgactgtgcaagctgcggaaacggtgcctgtggaagccggtttttcgataacagtgtggatgacaaataggggggatgaacaatgtcaaatttattattagtcgcaatcggtgcggcattagttaataacgtagtattgagccagttcctaggcctttgtcctttccttggtgtatccaagaaggtagaaactgccggcggaatgggcgctgcggttattttcgtcatcacaatcgcctcagcggttacctatttcgtttatgcgggcatactcgtaccgtttcatctggaatatcttcagacgatcgcatttatccttgtcattgcggcattggttcagttcgtggaaatgtttttaaagaaatctatgccggctctttatgagtctttaggcgtatatcttccgctgatcactaccaactgtgcggtgctcggtgttgcattgaataacgttcagtatgattacaactttattaccagtgtagtcaacggatttggagtggctgtcggatttaccatcgccatcgtgatcctggctggtatccgcgagaaattagaatacaacaacatcccggaatctttcaaaggaatgccgatcactcttgtcacggcagggctgatggctatcgctttctttggattctcaggaatcatatagggaggtagcaaaaatggatattacagcaattatcctcgcggccgtcgtggtcggaggcattggtttggtcattgctattcttttgggaatcgcttctgagaagtttaaggttccggtcaatgaaaaagaagtagcagtccgcgcagaacttcccggaaataactgcggaggctgcggatatgccggatgcgacgggcttgcaaaagcgatcgcgaacggagaagctgcggtcaatgcctgtccggtaggcgggcctgcggcggcagaaaaaatcggtgccatcatgggtgtggaagccggtgacttcgtaaaacaggtggcattcgtaaagtgtgcggggacctgtgagaaagcatcaaataaatacgaatatacaggacagatgagctgtgtggaagccatgaacgtacccggagaggggcccaaagcatgctctttcggatgtatgggattcggaagctgcgcccaggtgtgccctgagaatgcaatctccatcgtcaacggtattgcgtatgttgacaaagaagcgtgcatcggctgcggaaaatgtaccgatatctgtccgaagggacttattgaactggttccttacgacaagaagcatttagtgcagtgtaattctaaagacaagggaaaagacgtcatgtccgtgtgcaaagccggatgtatcggctgcgggctctgtgcgaaagaatgtaagcttggagcgattaccgtagaaaataacattgctcatatagactatgagaaatgtgtcaactgcggactctgtgccaagaagtgtccgaaaaaaatcattactgtataataaagtgaattatataaagatcattaggctgtatctgactggaggatacagcctttttgacacattttatttcctggggcatacactattataactatttttctggggtggcgtttcatgaagtttttagagttgagggaaaaggatgttatcaactgccggaccggagataaactgggatgtgtaatcgacctggagtttgacctggcgtcaggtcagattttatgtctgatcgttccaaaagcgacaaagatcctatgttttacaaaaggagagttttattatattccatataagaagatcattcgaatcggctgtgacactgtattggtggatattaatgaaaaagaatgtttgaagtgatctggaaaaaatgatatacttcctttaacgaatggaaagtcttgaggcagacgtgttctgcctctcaaaagagtacaaagaaaagcatagcccgggaggtagaaaaatgaggtgcccttattgcggaagtgaaaattccagagtcattgattccagacattcggaagacaataactctatacggagaagacgacagtgtgacgactgcagcaagcgtttcacgacctatgaaaagatcgagacagaaccgctgtctgtgatcaagaaggacaagaccagacagatgtatgaccgctccaagatcaaggcgggtatcgtacagtcctgccacaagctgcctatatccatgggacagatagatcagattgtagatgagatcgagacaaagatctataatctcggacagcgcgaggtagagagttccctgatcggagaaatcgtcatggacaagctgaaggaactgaatgaggtggcatatgtaaggtttgccgctatatacagagagttcaaagatgtgaacaccttcatgagtgaactgaaaaaattgctgaaatagttgtaaaaaaatagaaaacatgataagatacagtatattgttagctgaaaggcttccggagaagaaggaggctttatgttttgttcgatgttaagcggcattgtttcaggcgccgcaggctgtatcattcaggtcgaagcggaactaagaagcggtctcccatactttactatggtaggccgcctttctaatgaagcaaaagaatccaggcacagggtggaatccgcactgcgggctctgggctgtccgctccctcctatgaaaattaccgtcaatttatctcctgccgacatcagaaagacaggaaccgcatttgatcttcccatcgcagcggccgttatggccggtctcaattatattccaattaacaaagaaccgcccatctgtctcctgggagagctgggattggacggcagtgtccatgggatcagacagtgcctgcccatcatcatggaagggagaaagcagggcatccggcgatttatggttccctatgatgatatggaatcccttgtacatatcagagatgtggaactggttccggtaaaacatctttccgatgccgtggactatttcagaagcgggtgtgtgcttccatatcattttaaggaaaaaaggatgatccttgacagccagtgtcatgatttttcagaaataaaaggacaggctttcttaaaaagagctctggaaatcgccgtaaccgggaggcataacattcttctgatcggagctccaggttgtggcaagactatggcgcttgaacggatttcttctatcatgaacagtttatccgaggaagaatatctggaggtgcaggctctgtatcaggcggccggtgtccaccgggaggcagaagatttttgtccgcctttccgaaaacctcattcttccatatccaggggagcgctgatcggtgggggagcggttccaaaagttggagagatcacacttgcccacaaaggtgtcctgttcctggatgaactggcacagtttgacgccaaatgcattgaagccctgagacagccgctggaagataagcagattattttaaacaggcttgggagagactataccatgcctgcggactttttacttgcagcggccatgaatccatgtccatgcggcaacagctttactccggaggcatgccggtgcagtgcgggtgaaaagcggtcctattatcacagactttcagggcccatactggaccgttttgatctgattctcacagttggacaggaggcaaagaaaatggacgccgagactgaaaattcggctgccatccgcagcagggttttggaaaatatcagggaggaacagagagaactctcggatactccgtattcttattacggtcagatacaggcagaggacttagaaaaaatctgtccgttgtccaaagaaagccgaagaatcttaaaagaagaacaaaagaaacatcatatttctatgcggggtattcataagattgtgaggacagcaaaaacgattgccggaatggaacagaaaagcgagatcggggagggacatcttatagaggcactgtctctgcgcaacatggagtttttatcggaggctgtgggatatgaatgaaaagatttcgtggttctggtttacgtcgcttcttgagatgaatcgaaagacgcagggtgagatcctttctgccattattcatccggaggaactcaggaagcttaatgcggagactgcaaagccatttcttaacaagagacagtaccggctttttcttgagacaagagatgaatcttatatctgtaagaagtacgaggagctaaaaaagcagaaaacagactatattatatggaaagaacctgattatccacagcggctcaaacagatctatgactatccgtttggcattttccgaaaaggcaggccgcaggaatcaaggctggtcattgccatagtaggggccagatcctgtactttatatggaagagagatggcaggatattttgcaaaagagctgtccaggaggggtgttttgatcgtcagcggcatggcaaggggaatcgacggagcttctcacagaggagccctggatgtaggcgcaccgacggcaggtgttctgggatgcgggattgaccggatttatccgaaagcacataaaaaactgttcgccgatgtagagaaacagggtgtgatctattctgagtatggtcccggcgtagagccgctttcttttctttttccgcagaggaacaggatcatcagtggcctttccgacggaattttcgtagtggaggccagagagaaaagtggatctctgatcacagcggactgcggattggaacaaaacaaagaaatttttgcactcccgggcaatgtgacgagtgatgtatcaaggggctgccatcgcctgatccagcaaggcgccaagctggtttccggccccgaagatatcttaaatgaatttccaaaattcagagtattttcacataatgtctgtcaatttgataaaaattcacttgctagaggtgaaaaaatggtgtatgatgttttgagtttggaacctaaatgcctggaacagatagcttcggaggcaaaactgccggtcacagaggctgtgacatccttatactatctacagaggcaggggttggcagaagaaatactgaaaaattattacataataaaaatataattaagaggtgcaaaaatgccaaaatacttagtaattgtagaatcaccagcgaaagcaaagacgatcaataaatttttagggaaaaattatacggtcattgcatccaacggtcatgtgagggatctccccaagagtacgatgggaatcgacctggaacataattttgaaccaaaatatattacgatccggggcaagggagaagtattggcggcattgaggaaagaagtgaaaaaggccgacaaagtttatctcgcgactgaccctgaccgggaaggggaagcaatttcatggcatctttattatgcgctgaaacttgagaataaaaaatgcagccgtatcacatttaatgagatcaccaagaatgcagtcaaggaatcattaaagcatgcgagagagatcgacatggacctggtggatgcccagcaggcaagacgtgttttagaccggattgtcgggtataagatcagtcctcttttatgggcaaagatcaagaggggattgagcgcaggccgggtacagtctgtggcgctccgcctgatctgtgaccgggaagaagagatcagcgctttcataccggaagaatactggtcactggatgcttttctgaatgtgaaagggagcaaaaagcccctggaggccaagtttgccggagacaaagacgggaagatcgagatcaagaatgaagaacagctgaacaagatccttgcggaacttgaaggcgccgaatttcatgttgacagcgtaaagacaggggagcgtatcaagaaagccccgcttccgtttacgaccagtacgatgcagcaggatgcatccagcaaactgaattttccgacagcaaaaaccatgaggattgctcagcagctgtatgagggtgtagacatcaaaggaaaaggcaccgtgggattgatcacttacctgcgtacagactccacaaggatttcggaagaggcagataagaatgccagagagttcatctctgaaacctacggaagtgattttgtcggaaacggacaagtttcaaaaaaggacgacaaaaatgtacaggacgcccatgaagccattcgtcccacttacatcgagaacaccccggcgagcttgaaagaacagctttccagagaccagttcaggctttatcagctgatctggaaccggtttatggcgagccgcatgagtgcagccaagtatgagactacatccgtaaagatcgatgccaacggataccgtttcaatgcttccgcatccaagatcgtttttgacggatttttgactgtgtacaacatcgacaatgagaaatcaaaaggtaatgtcatactgaaaagtatcgatacttccacggagctgaagttaaaagagtttgaccacaaacagcattttacacagccgccggcccactacacggaagcaacgcttgtccgcaccctggaagaacagggtattggacggccgagtacgtatgctcctaccatatctacgatcattgccagaaggtatgtggtcaaggaaaagaagaatctgtatatgacggagctgggagaagcggtcaataccatgatgaaaaaggcatttccgtctatcgtggatgtgcatttcaccgctacgatggaggcgcttttggatatggtggaggaaggcaaggtccactggaaatccgtggtggaaaacttctatccggatcttaaagaagccgtggaggccgcagaaaaagaactggagcaggtaaccattgaggacgaagtgaccgatgtggtctgtgaccagtgcggacgcaatatggtcgtgaaatatgggccgtatgggaagtttctggcctgtccgggattccctgactgccgaaacacaaaacctcactttgaaaagatcggagttccatgtccgctgtgcggaaaggaagtcgtcttaaagaaaaccaagaagggtcggaaatactacggatgtgaggataacccggaatgcgaatttatgtcatggcagaagccttctaccgtcaagtgtgagcgctgcggaaagtatatggtggaaaaaggaaagaaactggtttgttcagacgaacactgcggatatgtatgtgatctgccgaaagaggaagaagttacggaaaataaggagtagctatgagtgtacaattattagataaaaccaggaagataaataaattactgcataacaacaattcacaaaaagtcgttttcaatgacatctgtcaggttctgatggaggttatggattccaatgtgatcgttatcagtagaaagggaaagatcttaggaattcaaaattcagagaacatagatcctatcgaagagatgatcagcggcaaaattggggattatattgacacggatttaaatgagcgtctgttgacgatattatccacgaaggagaatgtaaatctccagacactcggttttgaaagagacattcaccgctactgcggtattatctccccgatcgatatcgcaggagagagatttggcacgctgtttatgtaccggatggaagatgactatacgattgatgatattatattggttgaatacggaacaacagtcgttggattggaaatgatgcgttctgtcagtgaagagatagagagtgaacgcagaaagcagaatatcatcgaatctgccttcagaactctctcctttacggaactggaagcggttcatcatatttttgatgagctgaacgggagcgagggtattttggttgccagcaagattgccgaccgtttcggcatcacccgttcagtcatcgtcaatgcactgagaaagctggagagtgcgggagtcatcgagtcccggtcttccggcatgaaaggaacttatatcaaggttgtaaatgacctgatttttggcgaattaaaccgggccgggcgtatctaagccggaagtgcgaaatttttcttgcattgtgtaaaacagatgtgctatactgtcaaaggtaaaaataaacacgccgttggaatttcggtaggtgccgagaggtttgccgggataatgacaatggtggaagcataaccaaaggagattttttatgagcgttatttcaatgaaacagttattagaagcaggtgttcacttcggacatcagacaagaagatggaatcctaaaatggctccgtatatatacacagagcgtaacggaatccacatcatcgaccttcagaaatccgtaggcatggtagacgatgcatacaacgcagtaaaagaatgtgttgcagaaggcggaaagatcttatttgtgggaacaaagaaacaggctcaggattctataaagacagaagcagagcgctgcggaatgttctatgtaaaccagagatggttaggtggaatgctcacaaacttcaagacaatcagaagccgtatcgaccgtttaaagaagatcaaaaagatggaagaagacggaacatttgaagttcttccaaagaaagaagtattagaacttagaaaagaaatggataaattacagaagaacttaggcggaatcgaggagatgaaagaaattccggatatgatcttcatcgtagatcctaaaaaagaaaatatctgtgttcaggaagcacacacattgggaattcctctggtaggtattgcagatacaaacagtgatcctgaagatttagaatacatcatcccaggaaacgatgatgcaatccgtgcagttaaattgatcacatccgcaatggctgatgctgttgtagaagcaaaccagggaatggatgctgctgatgtggaagcagaagaggaagctgcagaacaataagatttatttggaggaaaaatcatggctattacagcaggaatggtaaaagaattaagagaaaaaaccggtgccggaatgatggactgtaaaaaggcattaaacgctaccgatggaaatatggaagcagcagttgagcacttaagagagcagggacttgcaaaggctgaaaagaaagccggacgtattgcggcagaaggattagttgctactaaactctctgatgacggaaagaaagctgctattgtggaagtaaactctgagactgacttcgttgctaagaacgaacagttccagacttatgttgcagaggttgcagatcaggctctcacaacaggtgcggcagatatcgaagctttccttgcagaagaatctaaagcagaagcaggaaaaactgtaaaagaagtattagacggaaaaattgcaatcatcggtgagaacttaaatatccgtagatttgcacagatggaatcagcagccggatttgttgcttcttatattcatgcaggcggaaagatcggcgtattagtagaagttgagacagatgttgtcaacgacgagatcaaagagatgggtaaaaacgtagctatgcaggtagctgctattatgccgaaatatacaagcagagatgaagtttctaaagattacatcgatcatgaaacagaaatcttaaaagctcaggctaagaatgaaaatccggacaagccggacaacatcatcgagaagatgatcatcggacgtctgaacaaagaattaaaagaagtttgtctgttagatcagacttatgtaaaggctgaagacggaaaacaggctgttggaaaatatgtagaagaagtagcaaaagctaattctgcaaagattgccattaaaggattcatccgttttgagacaggcgaaggaatcgaaaagaaagaagagaactttgctgaggaagtggcaaagcagatgggaaactaatccgtttgtaattagactgccattatcagtgtagaataacgggtttactgagatttccgaactttttacaagtaatgctatcatagattatcataaaatatcgcgttattttgggtaatacatgggtcagagattgggtaggatttattacctaacttatcaatgaaaagattgcttgatgtttaagtaggaaggaaagtgtagactggacagaaagggacattgtgaaaacaagggtcccttttgtcttagaaaatatttatttccgaagggcctatcggcatggtgtccactctaattttattgtcatatcaaagctcatttaatcgtggtaaatcagtagtaaaataagtgctttttaaattgttatattgcggataaatacagtgtttatgcgataatcgccatttctatatcaaattatacaaacatttttttaaaataacattgacaaaaaatttgtgttttgatatcatgtacttgtaaagaaaagcggaatgttactgtgtaagcaggcttaaccaaaatctttcaataacgtttattgttatttaatgattttggttaagcctgtttttttgctgcgcaaaaaatgaatcaagcactgccagcaatcagaacaagcaggaaattccagaagggaggttatattatgggtattttatcacgtatcatggggaaatcggaaagtacactcacggaattggtaaagccgtcaaaagaacttggcagccctttaatgggtgaagtcatcccgttagaaacagtgaatgacgaagcttttgcgaagaaatccatgggtgacggattggccattatcccggcagagggcaagctttacgcccctatgagcggcatggtagaagcgctttttcccaccaatcacgccatagccattgcaggagataacggtatcaatgtaattctgcatatcggcattgacacagtggaaatgggcggagacggttttgaagcgctggtgcagcagggtgaccgggtggaaaagggtcagtttctgatcacctttgatatggacaaaattaaaagcagcggttacgaggctactaccatggtgctactgccggatagcagcgaacttggtattttgcataaaagggacatcggacaggttatgccacaggaaaaacttttgtggcttggctgatggaaaggaattcttatgaggattaaaagaatttacaataacaacgtagtaatggtggaagatcaaaaaagcgaggaaatgatcgtcataggaaaaggtctggcctttggcaaaaaagccggtgagttccttgaagaagaccggattgaaaaagtttttactctggctgaaaaaagcatcggaaaccggctggctaagttggtgcaggaaatcccaatcatttatctgtctattgcagaagaaatcgtagccatgcttcgggaaaaatcggatttaaatctggatgacaatatttatatcacactgacagaccacatcagcatgtccttagagcgggaaaagaataaagtggtgttccagaatcccctgcttatggagatcaagcagttttataaaaaagaattcgctctttctaaagaagcagcaaaaatcattgataagcatatgggtattcatatttccgaagatgaaatggggtttattacgttacatatcgtaaatgccaacttaaaccagcgggcagaccaactgattgtaagtctccagctaatcagcgaaattataagaatcgtgcagaatcattatggagtggtactcaatcatgattccctattatacgaacgatttatgcggcatctgcagttttttgccagaagggtgctggacaaggatggcaaacaactggaagatgtatctgtatttcagctggcgcagcaggaatatccagaagcctttcagtgtgtggagaggataggagattatatacaaaagagctatcataaaaaggtgacggattcagaaaaaagatatctgatttatcacattattacattgatttcaaatgaaggagttcaagaatgaaagaaaaaatcaaaagttctttggaagtattttcaaagtcaattgtacagcctatgatgtatctgggggtagctggtacgattctgattcttggtattttattgaccaacacaacgattacggaaaagctgacttttttacaggcagcgcctttccggttaattggtaacttgatttatagcacattgatgtatctgatcaataacttaagcattattttctgtgtcggcattgcaggcgctatggcaaagaaagacaaaggtcatgcttctttaatcggcctgatgggcttcttcatatttttaaatgctaacaacattactttaaatttttttggcaagattgcagagccgggtacgcttggtctgtacggtacaggtcaggctgaggtaatgggcattcaggtactggacaccggtgtatttggcggtattttgatgggctgccttaccggatatctgttcaataagtttggtggtaagcagttcaaaggatacttctccatgttctccggcgtgcgcttcccgttcttattgatgattcctgctgctatcggcgtgggctttctcatgaccttcgtatggccgttagtgcagtctgcaatcagtgcagtatccggcatgatcgtaagcagcggcaatgtaggcctgtttgtatacggtctgttaaataagctgttagttcctaccggtctgcaccatctggtatatgcacctttccagtttactgatgtgggcggcacattggcacagggcaataccatcatagcaggtgcatatcctatccgtgtagcagagatgaatatgcctggggctttctcagactctacctattttaacagctacacctttaacaacctgttcccttatattggcatcgccctggcatttattactactgcatttaaaaaaaataaagaaaagaccagggcgctcattctgcctttgatgctgacagcagtattgtctgcaattaccgaacctattgactatttattcgtctttgcagcgccggttttattcctgattcattctgtaatcagcggtatcaatctggtattgttaaaagtattgagtatcccggcttctaccagcggcggtattgtcaacattataatttccaatctggtactgggcgtggaaaagactaactggcctatgttattggttatgggtatcgcagtcagcgtaatttactatttcctgttcactttcttaattaagaaactgaatttaagaactcctggccgcgaggtggaaaatattgcagaaaaagcagcaccgtctgttggcgcttccaacgcagcggatgatgtcgtcagcctgatcaatggtctgggaggcaaaagcaatattgattcactggaaaactgcttcacccgtttaagagtggttgtaaaggatgaatccctgattaatgaaaccctgattaataaagtaaagaacagcggtatcaagcgcagtggaaaggatctccagattattctgggcatgcaggtagcggctgttcgcggtcaggtagaggacgcattagaaaaaatgtaaattaatatttttaaggaggaaaagcatatgatcattacaattgttggcggcggcagtacctttacaccgggtattgtaaaatccatcgctcttcgcaagaatgagctggaggtagatgagatccgtctgtttgatttagataaaaaacgtcaggataaggttggcattttggttcgttggattctggatgaggatttaaaatgcggaattaaactgacaatcacctatgacgcagaagaagcttataaagatgctgatttcatttttgcacagatgcgcgtaggaaaatatgcaatgcgtgagttggatgaaaaaatccctcttcgtcacggctgtgtgggtcaggagacctgcggctgcggcggcctggcttatggtatgcgtacaatcttccctatgattcaggtaattgatgatgccgaaaaatatgcaaaaccaacctactggattttgaactactccaatccggcttccgtcgtatcggaagcctgccgtaagcttcgtcctgatgctcgcattattaatatctgcgacatgcctattgctatcattgatatggttgctgccgctctgaacattaaagataaacataacattgtttatgactattatggactgaatcactttggctggtttacgggcatcgaatacaagggcgaggatatgatgcctaagatcagagactatatcatggagcaggaaatcctgctgccgtctgcgtatttaaaagataaggcagctttagctggtaagagcaacgacaataaaacaaatcgccacgccaaaggcagctggtactatgtatggaagggtgtgtacgaaatcatgaagaatttcccggacactctgcctaacacttacttaaactactatctgcagcagaaagagtttgtggaacattccgatcctaatcatacccgtgccaacgaggttatggagactcgtgaaaagaatctgttcgacggtatcgacaaatatctggcttccggcgagattgacgaaacagtattctatgcaggcagtcatggtgattggattgccgatttggctatcgcattgaaaaacgacaccaaagcgcgttttctggtcatcaccgaaaacaagggagctatccccaacatgccttacgatgctatggtagaagtacctgcctacatcggtaagaaaggcccggaagtcatcgcacaggataatatcccgctattccagcaaggaatgatgatgcagcagttaaactgtgaaaaactcttagtagagggctgtatcgagggttcctatcagaaagtactggaagcctttaccctgaataagactgttccaagcatgaaagtggcaaaagagatattagacgatttgatggaagctaataaggaatactggccgacattgaagtaattatataaagaaagctcgaaaactttacggttcgggctttctttcgttgtgcgcccggcgggcgcacgttctgtagcaacaccgcaagaaccgtatcatcaatgtataccaccagttgttgagaaataagaaagtgggagttatcggacgcaagagatttagcggcggctctgtctaatacaaaaatacaaaataatcttcgggatgggctgccttacccttacactgagaaggatggaacagcatatataacggaggtgctttctgcagacgaagataaaacttttgcttttgctgtcacagcagacaacaaagtgatcggcagtattggagtgttccgtcaagagaacatacacagacagactggtgagttgggctattgtatagcagaagaatactggggcaaaggaataatgaccgaagctgtaaaacaaatttgtacatatgtctttgacaagagtgatattattcgaatctatgctgagccgtttgcatacaatgccgcatcatgccgggtactcgaaaaagccggttttcaatatgagggaacattgagaaataacgccatgaaaaatggtaaagtcattgatatgaggatgtattcactgctgaaaacagtaacgtatatttgaaactgataaatatgatgaggtgagaagatgctaacaggatactactgcacaaacatattttctgagcaggtaaaggaacttattgagttctatacagaaatggaacttacgaggtccgtttaagtgatattgatggaaatgagatagtgatcgctgagtttgcgtgattgaaaactttctgattggcagacagaaaaatcagaattatttaatcaagcaatggttgacaagatcccataaacaagagattataaaaaaggcggtgctcagagatggagacaatgttctggacgtcgcttgcggcaatggatatctgcttggagaactctcaaaaaaggcgagagttaatgcctttggtgtagatattgctgaaaatatgattgcgtctgccagagaaagatacccggcctgtacatttacggttggcccctgtgcgcctctcggttttgaaaatgagagtatggatgttattacggtatcctgcgcgttccatcattttgaaaatccccagacctttgccgatgaatgtttgcgggtattaaaggtaaatggtaaagtttttattgctgaaccgtttttttctcctctggtgcggtgtcttgccaacacgctggtatttcccttttcaaaaaaaggtgatgtgagggtgtacagccaaagagaacttcaattattttttgaatctgctggattcactgagtttgaatcgtacataacagatacagtcctatttttatcggcagaaaaatgaaagtatggggaaatcatgggaaggaaaaaccatcagattttatgaatataacatgacgaaagatctctttgatgaagaagccggagatattccgcctgactatctgtgcagatgctgagcggttctctgacttttttgaccgtgattcgctgctgattcattattacagaggccagacgagaggctccatggattatttaaggtttttttgagagaaagcgatctgtgcggccgaatgggcggagacgaatttatggtcttattgagaaacattgggtccgaggatgatgtgattccgagaagcaatatgctctgttatctgctgcgtcgcaaatatgcggataaaggggaggtatccttcagcatgggagtggtattttatccctgtgacggggagatttttcaggaactttaccaaaatgcagacactgctctatataaagtgaagagcaccgggagaggaaattacggaatatacaagcctgagcgataaaaagttctgtatcggaggaaaacatgtatttttttatagagtatcagtcacctttagggatgctgaccattgcctcagacggcgataatattgtgggtctttggatggaaggacagaaatattttggaggaacgctctcaggagatatggagaaaaaagatggtcttttcgtgtttaaaacagtagaagactggctggaccggtattttgccggggaaaagccttccatttctgagcttcctttatgtccgaaaggcggggaattcaggcagggcgtgtgggaaattctgcgtgagattccctatggaaaagtgatgagctacggcgaaattgccgggaagatggctgcaaagacgggcagagcacgaatgtctgcccaggcagtcggaggggcggtcggtcataatcccatttctattatcattccctgccaccgggtagttgggtctaatggaagcctgacgggatatgcagggggcattgccgccaaaataaaactgcttgagcatgaaggggcagatatgtcacagttgtttgttcccaaaaagggaactgctctttaaaggagaagattttatggaatggccggatgagaaacagagatgtacatgggcaaatccaaagaatgagctttatatccgttatcatgatgaggaatggggggtcccggtatatgatgatcacagattatttgagatgctggtcctggaatcctttcaggcggggctgtcatgggaatgtgtgctgaacaaacgggaggcattccgtgaggcttttgacgattttgatttagaaaaagtatgtgcttatacggaagacaagctgctgaaacttcagcagaatccggggattatccgcaataagctgaaaatcagagcggcggtaaacaatgcagagatattccgggagatacagagagaatacggctctttttcaaactatatctggcactggacggatggaaaagtaatctttgaaaaaggaatggcctgctccgaactgtcggatgccgtatccgaggacctcaggaaaagaggcatgaagtttgtggggacaacgattatatatgcgtatttacagtcggtaggcgtaatatattctcatgacgaaggctgctttttggaacatggcctgtcgtgacagtgataactttgtcaaatttatttttgataaatacagcactggaacaaatggatttttggaaacagagtttatataatctatatataagcaacaactaaatttaaaattggaggaaataaaatggcagacaataaagtatttaatgaaaataatattcgtctcaatgtaaaactggattcaaaagaagatgcaatcagggcagcaggcggcgtactgattgaaaatggttatgttcagcctgaatacctggaagatatgctgaaacgtgaggaggcagcttgcacttatattggaaatcatgtcggaattccgcacggtatctgcaagtcagaggagaggatcaagtcctccggaatctcactgctgcaagttccggacggagtggactatgacggacagactgcttatgtgatcatagggattgcagggaaaaatgacgaacatattgaaatgctcggcaagatcgcagtcacatgttccgaccttgccaatgtggataagatagcccatgcgaaatcaaagcaggaaatcttggatatctttgaaggaatctgataaaggcaaaataatatcggccatgaagaagaatgtgtaaggtttaaaggacttcacattctttttctcttttatctgccggaattctaccacaggtagatagtatttcataaaaatctaaggcacaataaacagtatcaaggaggcagttatggatatacaaaaaatcggaaatcacataaaatgtaaaggaaaagcacagggattgacacaggctgagctgctcggcattacaaatgaagcttgtggcgggacatgatatagagagtacacagctgccggaagccagtgaacagaatatgaaaacaatgttagggagctgccagcatttaagatcactgaaagatgtgtgcatcggtttgctgctgctgttcgtcggacgcctgatgcctctcacgcagttaaaggatatgacgtccgatgcttcgcagtttatatttggcgtatccgaaggtatatctatcggcattaccctgattggcattggctggctgatttttggagcagtcaaattcagcaaaaaggagaaataatatgcttttgcagctattaatcggatatactctggatatcgtcaaaagaaatacttttttctccgacgaagattctgcggaataccggatcaataaaagatacttttccttttgtctctgcatatgcacttttttcgtaatgaacaatgcatatattcgatcctttgccaatcgattttattttttgatttaaaagtcttaattcctcttccgtcaattctttttttggaactgactgcttttctatctcgcggagcatttcatcaaaacctcttaaagcggcaaacggaagaaattgtcttgcccggtcagctttcattgtggcctccgattaaagtattgcgttttctggcagttgctttttcatacaggctcattccccgcaccacggcattttttccgaaccgatgcttaatggaaaggacggcatcctgcagatgctgttccttttcagctttttccatatccgaaaacagatgaagctgccggaaggaagtctcctccacatgatttgcaccgacagagattttgcggatgggaatgcccctctgcacagtctggtgaaagaaacgttcaaattcatgggagagttcccgataggaatcggtccgctccgaaagtttcctggtgccgccggacggagagagttctcttttggagtatgcgacggacatggaaatggaatcggttgtcagatgacggctcctgagttccagagccagtgcatctgtcatctctttgaggactagaagagcattgtcataagaataatcttcaaagaggatctggctttgggaaacagagtggcttttagactcataatcatgaatttcttttatggtacacggctccctcccgtgggcatggtcgatcagaaactctgcattgacaccgaattctttatagagaagcttttcatccatatgtgctgtcccgtaaagatcgtaaatgccataacggctgagcctggcggcgatgccttttccgatattccatatatctgtgattgggcggtgatgccagatggtcctcttaaattctttttcatccagataaccgatatgatccggagaatgctttgcggtgatatccagagcgacctttgccagaaacaggtttgtgccgatgcctgccgtggcacagattccggtttctctgcggactgcatccgtcagcatgaccgccatttctttcggagtttttccatacgtatgcagataaggcgtgaaatccaggaagcattcgtcaatggaataaacatgaatatcttctttgctgacatattttaaataaatggagtagatccgggcggaatattccatatagagcttcatccgcggctttgcagtgatatatgtcacagtttccggaatttcaaaaagacggcagcggtttttgattccaagagatttcagggccggcgtgacggcgaggcatatggcaccccggcctctggacggatcggcgaccacgaggttttctttaaatgggtcgagtttccgttcggcagcttccactgaagcataaaagcttttcaggtcaatacatgcatagattgatttctccataaatacgacactcctttctgatttgagtatagcacagctgatacggcaaggaaacgtgtgttcgataaaatgagtgtggtaatttatggggcaaaaaattcttgacatggagttgactctagggagtatcctataataaaaggaggtttcattatgaaggtattaatgatcaatgggagtcctcactcaagggggaatacatatgtggcactgcatgaaatggaaaagatatttttggaagaaagcattaaaactgagatagtccaagtaggaagcaaggatatcagaggatgtgtggcctgtaattcctgtgtggaaaaagggaaatgtgtatttaatgatatcgtcaatgagacagcaccgaaattcgaagaatgtgatgggctggtggtagccagtccggtctattatgcttcggcaaatgctacactgagtgcctttcttgatcggctgttttacagcacacaatttgataagaccatgaaggtcggtgcatgtgctgtggcagcaagacgcggaggcttatccgccacgtttgaccagctgaacaaatattttacgattacagggatgccagttgcatccagccaatactggaacagcatacacggcagagagcccggtgaggccggccaggatgaagaaggactgcagacgatgagaactctggcgaaaaatatggctttccttatgaaaagcattgctctcggaagggaagcatatggattgcctgagaaggaaacattcaaacggacaaattttatcaggtaatgaccagaaagaagggatacaatgaataaaaaaatattagttgcctatttttcggcaacaggtacaacaaaaaaggccgcccaggcgctggcagaagcggcacatgcagatatttacgaaattaagccggaagttccgtatacaaaagatgatttgaactggacggacaaaaagtcccgcagttctgtggagatgagcgatcagagctatcggcccgcaatcgctgatcaaagtgaggaaattggaaactatgatttcatttttcttggatatcctaaaatgcagtattgtttatgatggtgtatcgtgtgtattgtgttataattatataagtatttattacagcatacacagatgatagaaaaaaatgtgtatagcgtttgtatagatgagacagtgtgagaactgccgagatgtgggcgaaaaatcgttaatttattatatgaaacaggaggttagaattatgagtgaaatattagtagcatatttttcagcaacacgaacaactgcaaaactggcaaagaaaattgcgaacgtagtaggtggggatttgcatgaaatttgtccggaaataccatatacctctgcggatcttgattggatgaataaaaatagccggagcagtgtggagatgaatgataagtcattcagaccgaaggttgctaataaactggaggatatagaaaatatcaaaattctgattcttgcttttcccatctggtggtacgttgctcctacaattattaatacgtttttggaacagtatgactggaatgacaagattattattccagtggcaacatctggaagcagcgggatgggcaataccaacgctgaattggagtcctcctgtccgggtgcgatactaaaggatggtaagagatttgatgtaaatgtgagtgaaaatgaaataaaagtatggtttgatagtctgagattttagaaaagctagcagctctttaaagtgataaatagaccttaaatgtagaaaagacttatttgtataaaagcagataagtcttttttgtgctagctctgccataaaaggtagagaggtatagattatactcagatacagaaatgacgaacacatatgttaaagtttaaaaactgaatcaattatagtattcttttacgcatgctttggactgtaggcaaagttcctttgaagtatatatgcactgctatacttctgaactgaaatactgtataataagacaaatacgaattgaacaaaatcgctatgccacagccttgacaggccatcgcgcagcgattttgttcaattagaagttagcgaggaagtttataaatgctgtctgtagattttttcatattaaacggaagtactattttaaaattggtaaaaaatatgttccagtttagttagattttagtggaagtgttaaatactttatcatatagttttccggctttctgcgtatattggaaaaagtctctgagctataaacaggcttttagaaaattatataactttcaggcagagagaacagagcctccaattctccatgattcgcgttttcaatatccagcgagccatccagggctttgtggagcctgtctgacaagcctgccccggaggcagtgcgcaaatactggtaaagcctttcgcagacatcagtgatattttctaaataggcatgataaagagggctgaattcatataccagcctgcttagctctgaagcctgtatacgtacgaaaggcctgaagtatcccggatagatttctttccaaaggcggatgtattcggtatgttccaggatatcctctattgcggagaccatatttgagatgcagatgtctttttctttttcatccagattggcaatatatctatgccgttcgtttttctgggaaaagatggaatcaatgacactggggtttaaagttttgataaaggcgtaaagtgatcgatagtcttcggacggatgttccagtgtagtctgttggagctttgcccaaagaaatttttggtattcggtaagttcgccctccggcaaaaaaccaccccaaaggaaacggttgataaaagtcaggtcatattggtcgaaacgctcgctgctataggaatcggataatttgtttaacccagaatgattgcccagagaaaaaagctcctcgaaatcaggttccagggacagatgttccatcatatattgcaggctgttaatgattttattaaagcaggcaatttcctgctgcagtttctttgcgtgctgattgagataatagctggctgtcagcggattggtgataatggaatggatcgcggatacggggaaatccgcgttccgcagatatcgtaccatgactaatttttggcagtcttcttccgagaaatcataataaccgtttgccggattcattttcggcgtaatgattccttgtttgatgtaataatgaatatttctctttgtaataccagtcttatgggatacttcctgtattctcatttttccaccagcttatcctacggaattgtatctaaatatgcttttattataacccgtaaaaagtatgcagtcaactgtatacttttgtgctgtatttttttcaataaaatttcatttacaaaaaagtgaccaatttatcctgcgcaaagaggaaaaaacgtctgagaaatttgtctgattttccctttttgacattcactttggtgaagggtatataatgatttcattataacaattataacagaagtaaaacaggaggaagtaaaatgtttgaaaaattattctcaccgatccggattaggggaatggaactgaaaaaccgtgtcatcatgcctgccatgggaaccaagttttccggtaataccagctttgtcacggacaagctgatcaactaccatgccgcgcgggcaaaagggggaagcgggctgaacatcgtggaagtcagcagtgtgcatacgccaagcgcgcccaggcagtttttgtccatcagtgacgatatgtttatcccgggcatgaagaagctgacggacgccatccacgcggaaggcggaaaagcgggtatccagctctggcagggctctctggcggtcggcatggatcagacggcgcagatcctgctggcaagcgatatggaggtagagccgggaatgacaattccggggattggcattgataccataaaggaagtggtgaacagctacggaaaagcggcaaaaagggctgtggaggcagggtttgactgtatcgaatttcattgcgcccatacttacctcccccattcgttcctgtctggcggcatcaaccaccgtacggatgaatacggcggttcctttgaaaacagggcaaaattcccgctggaatgtatccgggcgatccgggaaaatatcccggaggatatgccgttattcatgaggatcggcgcccaggatgacgatctggaaggcggacttacgatagaagaagtcattgatttttgcaaactggcaggagaatccggtgtggatgtattagatgtttccagaggaaatatcctttcctccgcgttaaaatatgaagtgccgcccatcgatcttcccagaggcttcaatgtggaaaacgcggcccgcatacggaaagaaacgggcatgctgacggtaggggttgggcgtatcaacatcccgtcactggcggaatcttatctggaagaagacaaggtggatatggtggtcatgggacgtgcccagcttgcggatcctgatttttgcaacaaagcaaaagcgggcgacttggatcatattacatactgcatcggatgcgaccagggatgctatgactattttgaaaatacggacacgccgcagatttcctgcctgagaaatccggctgtgggctatgaagaggaatacgcaatcaggaagacggaacagcctgagacggtactggttgccggaggcggaatcggtgggctgcacgcggccatcgttttaaagaagcgcggccatcaccccatcctgtgtgaaaaaacggatcgattaggcgggcagtttgtgcttgcaggagaggcacccagaaaagaagaaatgaaaaatgccgtgctttccatggcaaggcaggctgaggagctgtgcgtggatatctgcctggatacgaccgtgacaaaggagctgatcgcagagatcaatcctcataccgtgatcaacgcgattggcgcggagccgatcattccgccgataccgggcgcggatctgccccatgttgtaaattctcatgatatattgggcggaaaagtgtctgtaagtggaaatatcgtcgtcatcggcggaggcatggtgggcatggaagtggcggaataccttgctgaaagaggctgtcaggtaacagacctggaaatgctgccggagttctgtatggacttaggatcaccgagaaaaatctgcgtgacggaacatatttacgcggcagggatcacgccggtaactgacatcactgttacggcaatcgaggaaggcaaagtgatcggcaaaaaaggggatgaggttatggaattcccctgcgatcatgcggtgattgccgtaggcgcggcttccagatgcggaaaagaaattgaagagggcgcaagggcaatcggtgcgggctatatgaaggtcggcgatgccggacaggcgagaagggcaatcgacgcggtcagggaagcccatatagcggctgtcacctttgacgacccggaggtgtatcaggatgtggtaaaaccccagaaactggtgatggttaccggtgtgacgggaaccatggggcaggagaccttaaagcagctcctgagccggagcaaccgctttaaggtacgtgcgttcgcgaggccgtctgatgtaaacaggaaaaagatgaaaaaatttgcggggccgaatctggaaatctgctggggcgaccttggaaattatgaggatatcaagagagctgtggacggggcggattatgtgctgcatatcggcgcaatggtatcccccgcggcagacaagtacccggaaaaaacactctataccaatatcgggtctacgttaagcattatcaaggccatcaaggaacaaccggatccggataaagtacattttgtctatgtgggcaccgtggcggaaaccggaaacagaacctatcccatccattggggcagggtgggagaccctatcaacccatccatatttgactattatgcgctctcgaaagtattttccgagatggcggtatttgagtccggcctgaagcactgggtatccatccgccagacaggccagcacccaagcaatgagagcgcaggcgaagagcctatcatcttccaccagccggcaaactgtgtgctggaatggagcacctccatcgaatccggtatctgcatggcaaatatctgtgaggactgggttccggaatccttctggaggaagggctataacctgagcagcggcaaaggataccgcctggcatgctgggagcagctggaagtggaactgaaaccgatggggatcacgatcaaagatttatatgacgcggacgcactgccgttttacaatttccacggacattatttctcagacgcggacaagctggatgagatccttcatttccgttgtatcccggcagagcagtactggggcggtgtccaggaggaaatgcagcggatgatggataatccgatgatcgcggctatgttccccacagcggagcagatgaaagcgcataataaagaaatcgggcagaagaaaggcggcctctattacgcattagagcacaatgatgaggactggatcaaggcgttcttcggttccagggaaaagcgcgccgcgatcaagagttgggatgatgtggagctgttccatccgagcgaagaggttacttatctggatcatggatatgatgaggaaaagggaatcgagaatctggatctggaggatctgaaaaaagcagcagaattccgcgggggcgaatgcctggccgaagagatgcctgccgatatctatacaccgatcaaatggaaatgtgcggatggacatatttttgaaatgtcagtcaatacggccctgcatggcgggcactggtgtccggaatgcctggcccatgaatggcattacggggatattgcgaagaagaacccgttctatgcgcaggtatggacaccaattcatggagaagaggatgattatgtcatttctatggaatttagtggatatgatgtcagcaatgagttaaagaaaaaacttggattataaaaaagtattttatattttttgcgaagaaagagcggcgaggatcaggccgctctttcttatacaccttttagatcaggacaactcttatggcagccgcaaaaagcaaaaggtttagatggacagattagagtatccggctttgttttcggtactgcatgggcgtgatgccatactgttttttaaaagcactttgaaaatgtgcctggctggaatagcagaaatagctgctgatctcagccaggctcttttctgtaaaagtgaacagcgtttgatctgggaagcaacgtcttcgatcgtaatcggttggttggtgtggcttctgatatagttcatgcagatatacagatcggcggacaacccgtctggcggcacggacgcttctcctacctttttacagaaatccacaagcatttggtatcgcagagaatcaattttttctatggactgcagctgttcacattcctgtatataaacattcataagatgatatgttttttcaatatcaacaccgcccgggatggcgccgagcatccctgcacttgtagcagtactgatgaatgtattttttgcctgccgcaggggggaatttgccagctttttgtcacttaggttgagcggtgaggatttcatatgtttcattaagagatcagggtttgccggagcgtatatggccgtaaagttctgtctctgcataataggtagagcggagggtgtcattttcctgattttccagaaagccttccacgttgacggattcccgcagcgtattatctgaaaagcttatttccagtatatcttgaatatccgcgcttttattatttaagatcagatggagcagggataaatgttttgcaaggcggatgcggtttgtcgggggtatggaatacaaaaattatgtgatggcttctttattttcaggcggaatgatggtttccctgttatatagattgatcagctgggctgtaacgggaacttcaaatacaggacctaacaggaccgtatagctggttccctcaataaggacacttccataaataatctcctgagaagaaaagtaaataaaggggttagggccatctgacagatcgggatagccttttcccaattccagggaaaacatttcggacattgtggagtactcctcatccctgccgttcagtaaattttctaaggaaagaaccgaaggtgggttgaataagagggcaagcccttgtgccctcttattcagcacacttttggtttttccgaattgaacaaagtcgcgtccgatatatggggattcaaatagccctctctttacctgtatgaggcattcactttctcaaatactctcgaccatcctgtcatttcacggacttttgggtatacttccccctttccccctattctgcgcgtctcatatttcattttccctgagtcacgcgctgctctttctatagccccatccagtacatgtttcataagctacagtcccaccgcagcggggacatactgtgacatcttttttatataggatctttattgcgtgtaccttgtcatctttcctgaaacgcctcaggaattcacggcagccgatcagattcctgcaaagggggatcagtttccgcttattatgattgctaagcagaccgtagtggcgtatcctgacaaagtttttcggtgggacatgcatcaaaaaccgacggacgaattccacaccctccaaggtcagttctttccagacacctccatctttgtagtcctttacccgtatcgttaccgtatcttcatccatacggaggatacggctgttactgatcgctatccgatgtgtatagcgcccccagataattcatgaccgtttcggcaccggcaaaagactcccggatatccgtaacccagtgtttcccataacaggcattcagtagttcctgatattcatagtggttgcggtacctggcggcgtttccctcatagcatagtttcccggcatcacgcagggctttgagcccggataataattttcccttaaacagcccggctaaggacttcccgggaagaaaaaagccatcctttttttgccgccaattccggtccgtgtccaaaccaccgccagtagacaccacatgaatatgcggatggtaggaaagattggatccccatgtatgcatgatactgatgcttgtgttccagaatcatccgtgggaccatgatgtcatcccaaaggatgtgcaggacattccgatagaaaaaacggatggcagaattataaagattcagggttgtggctttcagcccttcatcttttttagcaagcaaaaaagtcctgacatcctgacaggtaagttcctccggattcttaccctgatatttcagaaagtaagagacatagtttttataacagttgatggaacgttctttaagattccggatttttgcggcttcctcaagtttttctaagtatttttcgtacataataaaatcctccatgtaaaatcagtagtatcaaaaagtcactgctttacacggaggcgcatttgggtcataaaaccgcttgccaaccaagcggaagggtgttattcttttcataggcagtgggaaggtcgatcctgtttgattgtttggtgtggtaacttaacaatactacttttaggacttgctttccactgtttttattacagaaaacagaaaatcgctatgtcacagccttggtaggccatcgcgcagcgattttgttcaattggaatttgatatgaaaaagggtaattaacatgaatagtaaaaaacttgtattcgcaattacattaatgtgctgtatcactctgtttgtcgggtgtgaaatgaaaaaaacacaggaaacagacaacgcattagcggcaacaataaacccggaagatgtttcggaggaacagcttattgagttcgtatcgccggaagatatagtaatttttcagattaacggaaaaaacgatattgccaattacctgcagaatgcgaattggacagagtgggaagaagttaatgaaattcctgcacaagctgaattacagtacatcatcatgtcttatgaaaaagtgacagacgaattttggcttgaaaaaggggcgccggaaattagcatgggagaggaacaattttatgaggataacgggaatttttatataaaagaactctttgaggataatcctgtaaagtatcatattccggtatcaaccggaaaatatattgtaaatctggtacagaagggttcggatatttcagataaaaatgatatttttgcatcttggggagtaaaagattttgagccgggcagcgcaaaagacttggacttggataattttgacggcttcagtggaggaaacgcggcaaagagccattcatatagtgcagatgagcttgcagatgtttcaaaagagcaaaaaatagaaattgtttttcagaatccagaagcatcttatacgatgacagagttggaggaaattgcagaattttataatcagataaagcaggatacatggacagaaatcggacaaatacctgatgaaaaaaatgatatatgtgcgataacgacttatcaattagagcgtcatacaaaagagaaaaatttggtggaaaatgaaaagatgactgtgtttgaagttcagaatcaatattatatattggatattattcccggcactctatccggcatggaggacatggagatatactattctattccgaatgatgttgccaactatatcaaggaaatagcacagtaaatttagaacaacgacaactttcagtttatcgaggagattgttgtataaattaattcaggtttgtcggtgagtaacacaacagagatctggacgagcatctcataggggttggtggggatatgaaaatggtggtcaagcgttttctgaatgccggaatgtctatggaagaactctctgtgaagatggatgcttctattgaggatttaacaaaacttctgaataactagagaaaaacataaaattttcaaatatgctctaaagcagaggaggataaaatgccatacacatttcaatcagtgaaaagcatgaaaaaattaacagatagcagtaaactatataattttattgaagacttttcaaattatggaaatcaatttccgctcatatgcggtaaaatcaaagcgctatttggtcaaccaatttatgaaacggaaaatatggagaatcttttttcatactgtattctggcgacatcggaagaagcggaagaagtttacttagatatttactgtgcaggctcaggtcttgcagttggcggtatgtcggacgaaaaatccagaaatgcagcaaaggctttagtagattatgttcgacaggcagaagcgattgactacgcatataaagcttactacttagacggacctactgctcttgaattcggaatcagagatggtgctccttattataacgaaacagagttaagactttcggagaaagaatttagagaactgtttttcaatatgtacaaaaacggggatgcaaaatgaaaaaatggtatgctgaagaatttgaatgggaaattggagttatcggttttctgagcggggctcataaagaaccgtgaaatggctgctcatgtgaaagaaaagggtcttgcagactatgtaacgcaggtagatattgccgtgcaaaatttcttaaagaaggaactgtttgcccttgcaccggatattcagtttcttggagaagaaaccggattgcaggagatagatgcggatagcttttggattttagacccggttgacgggactacaaaccttatgcacgattatcagcacagtgctgtatctttagccctttgccgccagggggaaattgttatggggatcgtgtatgatcccttccatgaagaagtgttttcagcggttaaaggcaagggcagcttcttaaatggacagcccatacatgtatcaaacgcagaaaaactatccgacacgatgattggattgggaacagcaaaaagagagctggccgatgaaaactttgcccggttccgcagggtgttcggtcagtgccaggatgtccgcaggattggttctgccgctctggaactggcatataccgcctgtggcagacaagggggatatttcgagatttacctgaatccctgggactatgctgccggtatgctgttgattcaggaagctggcggtcaaatgactgattttacggggaaaccgcttgacccgaaaaagggcagcagcgtagcagctacaaacggatatatacatacagaactgctaaagttgatataaagggtaataatcaggtgagtgttaagaaaaaatgaaataaggaaatccgaatgggaggaacgcaatacttgttcgtgcattggatgatggggaaacggttgcttttttacattaacttttggtagaccctgcatatcaagggctacatattgaagatgaattgatgaaacagattatgagctgctttgaaagtcttttgtatgtaaaggtcatgccgtctgacccgaaaacgattccattttatgaacggtatggttttcagcaatatgacaattactcggcgatggtacgaaaacactttgtgtaatgcgataactttcagttcgtctataaattgaccaaaacaaaaaaacgaaagggatgggcatatcatagaggttggcgtggatttagtaaagctgctgtatagctgagcgggaaagaaaatcagaagttgtgaagcttgaaaattttaagttgcttttatgcgttcttggtggaaaaggtgtatttcaaattgaaaggatggtcgggtgctaatgaaagaaatcatcaacttcattgaagcgaatgtggatggcaaaacgctgtctacaaaggaattagtttacgaacttgaaaatggtgtgttacagggcgtttactttgattcaatatctttctctaatctaaaatattctcagagtggatttcagttggatatgtttattgtatctaatgagaagatatggctcatgggaaaggatggagaacgggaaaaattgcgaaaagatttcagtggtgtatccctgttccgatttgaactggcggagcgaaaaagcacgaatagtttgactggctgttttcgtttcatttcagcttcagggaaaaatgtggcagcagaggctatcgtaagtggaatttatgatgtgcgtcttgaaaatgatgtgctgaagttatcggaagatcaagtcttgtatcgggatcagccgatacaagaagggcattttaagcccgttgcatttcaatcagaacattgtttttatgttaaagctaataagctacactatgaatacaacggcaagtgttttgatgtggactcaaaaactatgcggcgtaacgatagctctgatacctttcctccgtttatttcaatcgagaagtaagaaatgacgaatcagtttgacaggagtgcagagatgttgattattatgagtatataaatgttctaaaagatatgcgaaatgtgtcacaatagaagatgctttggaaatgctaatagataaatagtaaagggaagttctcgatgataaataaaaaaatgatagccttttgtggtacatattgcggcgtgtgtgaatggaaagataaaatcgggtgtaagggctgcaaagccaatagaggaattatgttttggggtaagtgcgataaagcgatatgctgtattgaaaaggggcttgaacattgtggggaatgctcagatatgccctgccaaaagctcagagacctgtttgatgatccagagcatggtgatcacggagcaagacttcgcaatctgaaaaattggaaagacggcatctgtgcctatgaaaaattaggtaatacagcgcaagagaaggcaaaaaatttgaaagcaatagaaaataccaatgactaggaaagataagattatttcaatggatgagtattagggcgatgacggtacagttccacaatggaaattggtaaaggtgattggaacaaatcatacactgactttcgggttaataattaaaatttgtgagagtatatactatgttcaatgatggtagaagtaaaaaggttgtttttgttgcctggctgattatgtagtgcaacatatcatggaatataagaaatatggatttgaagttatcggtattattggggcaaatcgttctccaaattgtggtgtcgaaacaacatcggacaatgatgcagaaatcaatggtatgggactatttatagaaaaaatttttcaccagcttttgcgagaaaacatatctattcccatgataggcataaagggaacggacaatatacaagaaaaacttcagcagttaggaagcaacgagatatattgcgcttttgcgtggagtcaatataagtggaaaaaataaagttccgatggctgaactgaagaaagcttttgaggagcttggattcggagcggttaagacctatctgaacagtggcaatgtgattttttcaagtgatgaagagaatatagtgagccttacagaccggattgaaacaacgataaaaaagtggtttggtctggatattccggttttcgtcatatcaaaagaggatctcgaagatattttgcaacacgcgcctgactggtggggtgatgaaaataaggaaatctatgataatctgatttttattatgcctccggctacatttgctgaagtgcgggacgagatcggagaacccagggagggtttggaaaagattcagaattataaggaagcggtattctggtctttcagccggaaggattatcaaaagacaaactggtggagggagacggcaagtgcgaatatcagcggcaaactgacaatccgaacggcaaacaccgtcaggaagataaatggcatgtaaggcttttaatatggagaagagctgggttagaataatataatggaaaggaattgctatgaaagaaatctatcagcaagcaaaattattacagtcagagttggtaaaaatcagaagagaaatacatcaaaatgctgaggttgggatacagctgcaatataccaaagcatttgtgaaagagaagctaattgcgtatggatatgaaccccaggacattgccaatagctcaattgtggcaacaatcagcggtgaactccccggtaaaactatgctgcttagagcagatatggacggcttagccattaaggaagaaactgatttagactttaaaagtgtaaacggagctatgcatggctgtggtcatgatatgcataccgccatgctgttaggtgctgcaaaattgcttaaaaagtatcaaaaccggcttcagggaaaagtaaaattattatttcaggaggatgaagaaggttttagcggggcgaaggctgcgattcaggacggtgttttggaaaatccaaaggtagatgcagccatggcgcttcatgtaaactctggtacgccgagcaatatggtgctgtgtggtcttggccatttcatggctggctgcactttgtttcgcattgaagtaagcggcgtgggctgtcacggagcgatgcctgaaaatggggttgatccaattaatattgcggcacatatttacctgtcgttacaggaaattgcagcgagagaagtggcggcgcaagacccttgtgtattaacgattggtaaatttgccggtgggcaaactcccaatattattcctgaaaaagtcgttttagagggaacaatccgttacaaaaataaagaaacaggggatagaatttttgaaagaattcaagaaatttcaaatctgtgtgcccaatccttcagaggaagggcagttgtaacggaattatccagtgcgccgcctctgataaacaacgatgagatgatctatgagttttgcgattacattaagcaattcattgcccctcagcaagtcaggatattgcctcagggaggtatgggcagcgaagactttgcttcctttagctatcaggtgcccattgcctatttattattaggcgccggtatcaaccaggaaaatgaagcgtatggtaaacccatgcataatcaaggcgttgtgtttaatgaagatatattgtcccttgggagttcgatactcacgatatgtgctatgaattggttgagcaaacatcgaaatgattaagacttattccgctcagcggcaaactgacaatcagaacggcaaacaccgtcagaaaaatagttggaatgtgtttattttccacattccaactgattgcatcttattttaaggaatctctgtcagggacctgcacagataaagcctcggtaaaatggtgtttctcaaccatatgcgcctgaactgaagttaaaatcaggcggtaacagtcggccagattctcggcaaactctgtgcttttccctgcacgcagacaatgatatgccctccttgtgatgtcattgagctgtacaattacatcacctccttggggataaaaagcgaaataaaacccccattctgtgatttggctgcattcataccagataacgtgtaatggttccagtgacaggtgttttaatatcatttgaaataaattcgtgagagcgatccctggcttcatgatatgaacagccagttgctctaaatcatcctcactaaattgcggcgccgtataggcagcgaccgtataggcagacacaccatattgttttgccagctgtgcttcatagggtaaataagttcctgccggatagatgcctgtccctatttttcgcgtcaagtcccggacaatgcgggtatagtagtaatctttccctctgataggattccattcaaatgtagcaggccgtttctgccattcaaatgcttagttgattcttatttgccaagggatagactgctccatcgctgagtgtttgacgattgacaaaggcttgtgtgttcagattatgcacatagggtcctatgatactgagccggaaacagtggctgtactggatgcgttccttggtgagaatgggtatgcaaatgatatggcagacgggcggctgctatttatcagacccgaaaaagaggctccggaaaagatgaaaacggttatccggcatccgataaaatgaatctaatgatatttgtgataaataaaattataaatgggaattataatattccccgaaaactgccccgccgataatcaaaactgcaccgatcatttgtaatggccgcattgtttctccgagtatgagtgttgcaagaattattgccgaaagcggctccaaatatccggagattgcgactgtttgaacaggcaattttccgatagaggaaaagtaaaaataacaccctatgcctgtattgaaaagccccaacactataacccatattaaattagttcttgatatggaaacctggtatcctgttttgagacctacgaaagcagcgactgttagaaaactcattaaaagctgaatggttgcgttttcaagaccttgcacctttttagatttcttgttgagtattaccataaaggaatacataatagcagacataattccacagaatattccaaaggcattgagattctctcccgacactgttccgtttaccaagaaaattccaataagtacagcaataaatccggcaattttatatgcggtcagcttctccttgaacagtatgggagacaatcccattacgatgactggaccgcaataataggaaagtgaagccaaacttacaccgatttggttgtatgcttcataaagaaacatccaacttgttcccattgttatacccgaaaaaacgataaacagagtatcatttttttctttcgcaaaggtaatcttttgtcttgtaacaaagaaaatcccaatcaaaagtaagctgccgataagtgttctccaaaatacgattttatagcttgataaatgaatattgctcgccacaattccgtttgagccgaaaagcagcaaagcaaatatatacttaaaaaatgcttttttcatcatctctgttttcctttgaataatgttccggcgccaaaaccttttacaatattataaattgcttcggtgttttttccgtttgtaatgatagtatcaataccttgcgctgttgccaattcggcggcttgtagcttggttttcataccgcccgttccacgctttgagcctgcaccaccagcaatagaatatacactttcgtcaatacgatcaattctctcaattagttttgcattgggatgtaggcgtggatcgctgtcgaaaagcccgtcaatatcagaaaggatgatcagtttgtttgctcggcataacactgctacaacagcagaaagcatatcgttatcaccgaaaagccgttcttccgattcgatttctgtatagcttaccgagtcattttcatttactatgggaatcgcacccatttcgagtagtgcatcaaatgtatttgttagattatctttcttttcttcttgctcaatatcttcggcgtttaacagaatttgaccgatgattttatcataatcattgaaaaacttatcgtataaatacataatactgcattgaccaaccgaagccgccgcttgtttcatacgcatactggtcggcttggttctcataccgagcttgttgcacccaacggcaatcgctcctgatgaaacgagtataacctcataacccatattttgtatatcggatagaacacgggcaaggttgtccattgctcgtaagtcgcttttcccgacatcatttgtcaaggtagatgtaccaaccttgactacgatacggttttgatacagtcccattattcacacctctacaaacagtacggtatgttttgtgaaaggcataaatttatgcaaaacatcttctgtcttaattttcatataacccgtagttgtaccatcactgcatccgtaatattcttctttcagaacttctttgtcaaagacaaactgcacatcttttgcgttatcaagcaaggcactaaatactgttgccgcgccgatttttgtgccgagcatttcgtccattttttcagcaggagtaaaagagaggcgtgaaactccaagagccgcactaaactctttggagcgaaatggcttatccccacaagtaacaaacagataaaatgatgtctgttgcctgttacatagaaataaagtttttaccattttcatatccaacttttcttctatcgcaacgcaatcttccatagtaattgcttcgtctgtatccactcgctcaaatggaatgtttaacttcaaaagcgtagtatacactttttcttgaagcggtgtttccatttttgaaggtttgtctgtttgaatatcgctaacataaaacataggctgaacctctttatcttgattttagtacctatagagtatatcataataatatacatctgaaaaacgaatgtttttcatgcttaaaattacaaaaacgcataacaggaggtggcatgatggatatgagcatcctaaaatatatggcatttataaaaacagtagagtgtgggagttttacgagggcggcagaaatactgaactattctcaatcgggtatcagccgaatgattggtgatttggaaaaagaatggaaggtgtccttgctggagcgtaaccgaaccggtgtaaagcttacctccgatggaacaaaactgctcccatacgcaagaaatgtttgcgaggaatatatgaagctgcaaatggaggtagatgacctaaatggactccaatcgggtcttattcgcattggaacaatttcgagcattgcaactcattggctgccgaatatcatagctgagtttcaaaagaagtacccgaatatcgactatgagttgctgatcggtcactatgccgatattgaggagtgggtgaatgagggtagagtggatattggctttacaagagttccaacacactccgatttggaaacagagttcttggagcaagacaaactgcttgtggttcttcccggaaatcatccgatgggaagtcttgataaatttcccgtttctgcattggcggaatatccttttatgttacttgaaaaaggagaaaaggcagaaatatcggaaatctttgaccgctgtggaatttcccccaacattcatttcataacggttgatgattacgccgtaatgtcgatggtagaaaaagggcttggtatcagcattttgccggagctcattttgagaagaacggcgtatcgtatcattacaaaagagcttgatgtgccatcctttagaaaattggggattgcaatgagagatagaaaaaacgcttctcttgcagtaaaaagatttttggagtatttagattacagaaacatataaacgaacagtgtcatttctaaaggcatcaaacataggagcaagcaatgaaggagtttgcagtggatctgcataattttcttggggaatttgcaccatggattgttattgctgtgtgcattgccgtttatagcacaacgcctattagagccggtatcaatgtttttgccttttttgcgggaatggtatcaagctactattggtacagcaattttatagcaggattttttccgaaaagctatgccattgtctggattacatttacagtgttatccccttttctcgcattttgtgttggtatgcaaaaggtacagggtggattgctttactcctgtcctccggggttacagggatattgctgaactgtgcattcagctatggaatgttttatgtagatatcagttcggggcttgagcttttaatgctggtgattggcgtgattgctttacgcagatctactaaggaaacagcaggtatgataggagcaggggcagtttttgccatcattatgaaagctgtcataccgtttcgtatctggtaaaaatgctgaactggaaatacagagaggagtgattcgctgtgtatactgaagacttagattttagatatgctaaacgagaagacacagcattgattttgcaatttatcaaagaacttgctgattatgaaaaaatgcttaacgaagtcgttgctgatgaagaaacattggaggaatggatttttgacaaacaaaaggcagaagtgattttcgctgtagtaaacggaaaagaagttggctttgctcttttctttcacaatttctctactttcttgggtagagccggaatttaccttgaagatttgtatgtaaagccagaatgcagaggaaaaggatatggaaaagcaattctgaaaagactggtggccattgctgttgaacggggttgcggccgattagaatggtggtgccttgactggaatagatcaagcattgatttttacctttctttaggagcagaacccatgtctgattggacagtatatcgtattgcaggagttacatttgagccttgtgacggccaggtcattcctgcacacgggacagcggctgataatctttttcatgcattcatttcctttctgttttctattaatataatattataacttataaatgtcaatattaatataataattaaatatattaatataaaaattgaataattgcagaatagcatagaaataatttttattaaaaaagagaactatggtacatttcgggaagtgcatataaagcaggaacaagcctctggagacagagagaacagcagaggacttgtccgcttgaaagttaaaaaccggtgattttttcggcgccttcaacgccgatttccaaaagagtctgttttgaggaagcaaaattatcctgaaacagaatctgaaatgtgtgggccagctgtgcatagtctgcacaggaacagctttctcgaatagaagcagaaattccggtccatccggaaaccggttcggtacctgtctcttccaggcggaggatgctgcctttcaatgacaggaggatgagtttcctgtaaatctcccggatagctgcaaggggacagtttctgattacagaccgcagtccgatgctgaccgtatgcaccagggattttttctcatcgggtttggatgcagcctcggaaagttctttcagcatttcatgcggaacatgagggagggatgcaagcataaccggactgcttgtgatcgcaaggatctgcagagcttccaaaaaatctctcatattgtttgcggcagacgcggcgaaaggatatagtgtgggcatgaatgactatctggcaaagtctgtggaaatcgatcgactattaagtgtactgcaaaaatggatgagttctcctctctcataatatcacagtgcagtactgtgggagagccaggtttgtattgaatttatttttgaaataagtacaataaaagagtaatacataatatttggcttagaaaagaggagttatgaaaaagtacaaagggatcgttttctttgattatgacggaacgactgtggacgatacagataatattagaaaagcaaccaaaaagacaatagaatctcttcgaagactaaaggaaaacggatatctgacaatgctgtgttcagggcgtagcaaacgttttctggaagcggatatcgataaatttgagggagccattacctgcaacgggtcctatacggaagtcggcggacaggttgtcagtgatattcacatttctgaagaggcaatgcagaaggtcatttccggatatttttcagaagatacggctctgcatatggagacacaggatgttacatattatatgcactataaccagccgttttaccatgatttccgggagtttcttggatttccggaacgctggttcgcaccgtgggagacgagaaaaggagagaatattacgaaaattgtgataaattacaacagggaagagctgatggatgaaatacagacggaattcgaaggggagctgcagtgtgtgaaaccttttgaagatatgaatattttagatattatgtcaagagggatcaccaagggaaatgccattataaatctcatggaccgatatggaatcggcaaaaaggactgttatgccttcggtgattccgataatgacatagagatgcttgaggctgtgggaaccggtattgtgatgggacggcacagcaaggcagcaggaaaagcggctgatatgctgacgggtaccgtaagagaagaaggcatcacgacggcgctggaatcaataggactgatataagatctatgaagaaatcatatttgttcagggggattttttatgcggcaggactttttatactggctctggggattaccctgaatacgaaaacaggcctgggagtatcgccgatcatatcagtttcatacagtatttcagctatttggaatctcaatttcggaaatatgacattggctctctatgggatcttcgtggctgctgaaatgcttctccataccatcagaaataaacggagcattaagagggaaggaaccggacttgtgaagaactgttttgacatattaaacatctccattacagccatggcaggcatggtttttggggggaaaatcatcggtattggcatcggaacggtggcggcggtgatcggagtcggacgaacgatttcaatattcaatcattttgtcaggaaaaaaatggatacactggcggggatgcaggcaaagtaatagaagtttaaggggtaaagttaagagttctgtccctgcagaaagcaggggaatcagttgacttttccggaagcaaaagaaaaagaagattatacaataacttacagcaacaacaccaataccggaagtgttactaagacattttatgttgttcccaaaaaacaaagattacctatgctaagtccaaaaaatccaggaagctgacgatataatacaagaaagcgacaggagcgggcagtttcctggtttatgattgtagtaaatagattatggatgagcgggaaaaattataaatacttttctccatatccatagttttctacgacatagtcgatatccttgtctccccggccgctcagacaaacgagaatggagcctttcttcatttcctgagctttctttgtagcataggctaccgcatgggaactctcgatggccgggatgatcccttcatagcgggacagttcaaaaaatgctttcatggcagcttcatcgtctgccgtctcataggaaacccgccctaaatcattcaggaatgcgtgctctggtccgacagagggatagtcaagtccactggcgatagagtagactggagcgggctccccggctccgtctttcagcatgatgctttcaaatccgtgcatgactcctttttctccataagtcatagaagcggcgtgatcgcctgggtttgagcctcggcccagcggctccacgcccacgatatctaccggctcatcgacaaagggaatgaacatgccgatggagttgcttcctcctccgacgcaggcgcagactacatccggcagcagtcctgtcatttctatgaactgttcttttgcctcatatcccacaacagactgaaagtcacggaccatcagcgggaatgggtgaggacccagggcagatccgatacagtaaatagaatctttatagttttttgcgtaagagtcaaatgcagaatcaacagcttcttttaaggtctttaatccgtgtgtgaccggaacgacgtttgcaccgaggattttcatgcgggtcacattgggagcctgctttgcaatatccacttctcccatatgtatctcacattccagtccgaaaaatgccgccgccgttgccagagccacgccgtgctgcccggctccggtctcggcgatcagacgtttctttcccatgaattttgccaggaggccttctcccatgcagtgattcagcttgtgggcaccggtatgatttaaatcttcccgtttcagatagatctggcagtttccgtacatgtttgagagccgttcacagtgatagaccggtgtgggccttccctggaattctctgcggattctccggagttcattgataaactgggatgagtggcagattgtctgataagcctctgagatttcttcaaaggcgggttttaactcatccgaaagataggcgccgccgtaagggccgaagcgtccttcgtcatccggataatttcgtaaatatgtcttgtaatccataaattcctcctgttatatcagttgtttaaagcaaagaatcttccttttgcttaatatatgtctcaaggctgcgtttatctatgagagaaggaacgacgccctcccgtgagatacaaaaacctgcggcgtagcaggcgatccggaccgcttcctccatcgaacatccataaagaagataggaggccaatgcgctgataaaagcgtcgctggcaccggtattgtccacggaaggaaacgggacagccgggaaatgtttttccagaccggcagaccggacatagcagccgttttctcccagtgtcacaatgaccgtctcaataccgcattccagcagggatgcggttttttcctgcagagtggaaggacccggacacagttcgttcagttcttcttcatttggcacaaggatatctaccatggaaagcacttccggagggatcgctccgcatacggaaggcttcaggatggtcctggcgccggattcatgtgcggtgcggcacgcttcggcaaccgtgtccagagggatttccgactggatgaggcagtatccggtatttttaaagaaacgttttcgcttctttatatcttcgggagacagaatgctgtttgcaccggagaggatagaaatcatggaatgaccgctggattctacaaaaatgaatgcctttccggttttctcctggttgcagcgtttcacaccgaaggactctacgccgtactctttgagagttttatagacagaggctgaatcaatatcggaccccacatttccaatcagtgttacccggtgtccaagcttcgccgcgccgatggactggtttatgccttttcctcccggataaatgaaggacgtggaagtgctcacggtttttccgctgtggggaagctgcggcacattcaggtaggtgtcgatattgatactgcccacaacggtgatcttgggaacattcaggttgaacggaacactgacggtggtctggttgtccagatgaaaatcctggacaaaggactgaggcttatccgtgcgcttttcgatctcggtgatcagtttgccgcacaggtaagatccaaaatcagcattcagcatcgtgtaggtagaaatctcggaaatattgggaaaggccaggttttccatcgtatcattctttagagatatgagcgaaatgtcttccgggactctgaagcttaatgtattcatgagctggtaaaattccagcgccttccggtaatgagatgatatgattccgctgatgctgtgggtgttcaccttgtgaatcagggtttcgtccagatcgtaaaagatcaggtctttgtcgattttcatgtgattgtcgaacagacactttttatacccgtttaagaaagcggatgtacggcggccttcttttaagatacaggcaattttgcggtgcttccgatcaatcaattcctgggtgatccggtaagcggcttcttcatatgggatcatatgggagtgatctccaccgttgggaccgatggtcatgagtggaatcttcatattctgaaaatgagttgaataggagagactttctttttctacgggctcccagataattccgtctacgttatttttgcagagggaagtgatatttttaagttcctgttccatgtcggagtaactgttatatacgagggtgctgtatccgtttgcctgggcggtctgaatgattccgtccagcgtggagtccaaagaaacagaagaccggagcaggatgcccaaaatccatgtctttgccggggaagcagtggcagctgcgtaaggagtgtaattatactctctaacgatctttaaaacccgttcccttgtttcgctgctgatgctttcatctttttggttgacaatttttgaaacggttgaggcagagacgcctgccagctgtgcgatttcctttatgttcataaaattcctccaacattatactacattccataatagacaaagaaagaatatctgtcaatatgtcggggtgtgcaaaataaacaagggttctggcggaaaaaacagaaaaagtaacattaagtgataaaaatgttgacaaactgtgagagcagtgttaattttaaataaagaaaatgatttcggaaaatagtttcctaggacatcagacgaaagaaatcagctgaaacagacatcgccatatataaaaaaaggaggatacattatgagtgagaaaaaagtcacgtttacagaaaggatcaagtctcaattttcgaccaagtctttggtgctgattccgatcgcggtgggcattaacctgatcggcggtacgctgtgctccgcgttgaagctgccgctgtttttggacatgatcggaactgttgtcgttgcctgtctgtccggcgtgtgggtcgccgcgctgtgcgggctgttgacaaatgtatttctggctatggcggcgaatcccgtatatctgccttattccattgtaagtataatgtgcgctgttgtgacgggatgtatggtgaaagcggggttttttaaaaaagtctggggagcggttctcacatggcttgcgtgtacgtttgtcaatacggtttctgcctcggtgatcacgatctttgtatacggcgggtcggcaggtgtgacaggaacttctgtgctgacggcaacattgattgcggctacgaaaaacattgcggcctctgtattatccacgtctatgattgaaaatctgatcgataagggaattacatttctcatagcttttgtcatcattcagaagattcctaagagatttttaagccagtatgcggctgatacggacgatgaggaagacggcgattaaataagaggaagacatttacgtacaggaggcagggatggcaacgatatcaaatacatttataccgaaaaatacggtaatagaacgactgaacccgatgaccaaaatcttcgcaatattttcccttggactcggaactctgatctctcccggcccgcggctcggactggcagttatcgcagggctgtttggggcggcatggctggcagggatcttaaaggattttgcaaaaattatgtttggattcggaataccagtcacagctatgctgctgtttattcagggctgttatcacccgggcaatgttacatttattgcggaccttggatttgcaaaagtgggactggaaggagtccgctatgcgctgaagattatcagtacgcttctggtgtttctgggaaccttctatattatgaacaaaacaacatatccggggaaactggtagctgcgctgacggaaagcgggatgccgcccaaagcaggatatctggtgctggcaagtttaaatgttgtcccgcagatgcagagaagaatgtctgtgatccgtgaagcacaggaagccagaggggtggagaccggagggggaatcacagcccggataaaagcctatattccgctgcttggaccggtcatcatgtcatcccttacggatgcccaggaaagaggcatgacgctggagacaagaggatttggaattgcaggggtaaagcccacggcttatgttgaagtctgcaaaacccggacagacagagcggtgaatattttcttaaccgcattttttattgcggttgtgtcggccgccgttttgacaaaacttgattttatataaaaaagaggagtgcaaatgggcagaatcatattagaagtcaaagatttttcttttaaatacaggcagacaaaacaaaaggccctgaaaaacatcagctttcaggtggaagaaggaaatttcttctgtgttatcggtgccaacggatcagggaaatccaccctgtgcagcgctctggcgggactcattcctcattactttacgggaaaaatgtcgggccgggtgatcgtggatgggatatcggcgggagaaagcaccattgcagagctgtcccaaaagattgggttcgtatttcagaatccgtttaaccagctgtcctatactgcaggaactgtcgctgaggaacttgcatatggacttggaaaccggggagtatccagaagaatgatgatggaaaaagtagagtttgtgtcaaaactcatgcggatcgaccatatccttgacaagaatcctctggaattatccgggggacaggtgcagagagtggcgttcggctctgcttttatcatggaaccggagattctcgttttagacgaatgtacgacacagcttgacccggcggggagcgaagaaatctttgatattgtgaaagaactgaataaaaaaggtgtcactgtcatcatggcggatcacgatatggaacgagtggcacggtgcgcggacaagatcctcgtccttgaaaaagggagagctgcggcgctggatgaaccgaaaaaaatatttggagatccggaaatcatgcagcatggagtcggcataccggattatgtggaaataacaagggccttaaaagaaaaacagtatacagaccgggacattgagattgctgaggggccggccatcgaaatggtgagggaggtgcttgacagatgcaaattgaattaaaaaatcttcactattcttatccgtccggaggtgaagtattaaaggggataaatctggtcatcggcgggacggagccagtagccatcatcggacagaacggagcgggaaagaccacggctgtaaaacattttaacggaatcttaagacccacgtccggggaagttctgatcaatggagagaacattgagacacggtccactgcacagtggtcaaagaaagtcggctatgtatttcaaaacccggatgatcagctgtttctggaatctgtcagaaaagaatttgaattcgggcccaggcagatcaaaatgccggagaaagaaatcaaaagaagaaacgaatgggtcgctgagcttgtgggaatgtcggaaaaactggatatgcatccgtttgacctgacgccgtcagagaaaaaattttgtaccataggcgcggtgctgatgatggatccggatgtgctgattttcgatgagcctacctgcgggcaggatgtgcagggaaatcatagactgctcagcattatcaaggcattgaaagagagagggaagttatgcattaccatttctcatgatatgaaatttgtagtcagcagttttaggcggatcatcgtcatgtgcggaggggaggtgatactggacggcagggccgaagaggtgtttgcccagacggagatattaaagaaaagttttgttgctcctcctccggtcacgaaagtggcacagggggcagggttgaaaaaaactgtttttactacagaagcatttatggaagcattggaagacgaaaggaaggtataaagaaatggcagacgtgattattcagatttatgggatcaggacagtgaaggatgcaaggatggttgttgaaatgggaggacaccacctgggagtatcctatggaaagatcaaaaggactccggggcagctttcctgtgagcgcgcaagagaaatttttgaaggggtgcagccggaagcggtgaggattggtctgacggtatcagaagatatcgatgagatcacagaagatcttaaagaagcattaccggacgttatgcacttatcaggagatattgagggcatcacaccggctcaggtacaggaactcaaagacagattccctggccttaagatcatgcaggcgatcccggttctggcgggagtaccgcttgaggaacagaaagtcatgcagtatatcagagactatgaaccggtgtcagatttcttcctgattgacacgaaggcgccgtctgcgggagatatcggtgcaacaggcctcacccacgaccgtgagattgacaaagcgatcatcgaaagcacggatgtaccatgtatcatcgcaggcggtctggatgcagacaatgtagcggaagccatccacattacacacccatatggagtggactcctttactatgacaaactatgatgacgagcgtgcggataccgaacgctgcaaagatccggctaaagtgaaagcgtttatcgaggctgcacagaatgcctgaggtgatggtggtcggcgatgccaccgtcgacattatcgtaccttatcctaagttcctcaataaagagaggactttggttgaatacccggagccatctattcggggaggagggacttccgccaacacggcagtggctttggcaagacttggagtcgaaacaggttttgtcggttccgtcggggaagaccagtatggaaggtatgtaaagaatgatctctcaaaagagggcgtggatatctccggcctgatcattgagccggaattaaatacggtcggagtgtttgcgttcatcgatgaaaacggagagcggtatctgtggggatggccgagagtggatcaggcatttaagacgctggatgcggataaagtgtcatttgaaaaggttcaaaaggcgaactgggtccactcctcaggaatgtcgctggcatatgatacctctgcccgcgatacagtaatccggatttttaagaaagcgcatgaggcaggggttcctacttcttttgacttaaatctgagggtggacaacggcatccttgatccggaatacgaaaaagcagtgcggcagatcattaaatatacagactatctgcttggctccggcaccgatgaatttgcctatcttggcagagagatggactggagagccaatgctgagtcgtttgtaaacaggagccggaccgtgatcgtgaggaacggcgcagaaggctcctacggatttactgagaaagaaaagacggcggcgcctgcttttccggtaaaggtagaggatacggtcggtgcaggtgatgtctacaatgccggatttatcagtgcggtgctggaggggaaatccctgaaggaatgcctgatcacagggaatgcagtatccggttatgccgtagcaaagaagggtgcgagaacttccccggatcaagaacagctgcagcgatttctggatgagtatagatcaaaggataaaggagaaaaaatatgaaaaaagtgattttagattgtgacccgggacatgacgatgcctttgccatgatgcttgcagtgcagaatttagatgtgcttggcatcactacgatcggcggaaactgcaccttggaaaacgtgacaaaaaatgcactgaaggtgctggaagtactggagagaacagatatccctgtcttcgcgggacattcctgcccaacaaccgtacccctggtgaccgcgccgcagtttcacggtgagacaggacttgacggccctgtgcttccggagccgtccgtaaaagcgcaggataagcatgcagttgattttattgtggagacagtgatgaacacagatgatgtgacactgattgccacaggtcctctgacaaatattgcggcagccatcaaccgggaaccaaagatcgttgaacgggtcaaagaactgagcattatgggaggctctgtgacctatggaaactggactccggcagcagaattcaacatctatgtagatccggaagcggcataccgggtgtttaactcaggaatgcatgtgaaaatgtccggaatcaatctgaccagacaatgctgcctgaccgccgaacatgtgaaaaagttccgggagataggaacgaaggcggcacactttgcggcagatctgacagaattttttattgataccacaataaagagcgcatctctttcaggggccaatatgcacgatgcctgtgcagtggcatggctgatcgatccgtctcttatcaaggcggctgacatgcatattgatatcgagctaaagggcgaactgacgagaggaatgactgtatgtgattaccggcatctaagaggtgtggaaccggctgtagatctgtgcagagaacctcagatggatttcagaggagaagtgccgaatgcggaagcagccctggaactggatttcccgggattcatggatctgctgtataagacgcttaagaattataagtgatgatgtacaaaatgatcttgtgggactttgacggcactttagcttatacgggcaaagatgtgtgggattctctgcaatatgctgctaaaaaatgcggcggggagctgccggaggctttcatcagtgaagacagcaatctgggaaaatctgtgaaggaggtttttgaccagatcgtcccccctccggaaagcgaaaaatatgaagagtttgaatccctggtgcgggtgcactaccgtatgtttaatgggtatcaacatacagaattctatcccggtatcagagaacttcttcagaagaccagagaaaaaggaattctacattatattgttaccatgaaacccaaagaagcattggaacggatcctattaaaaaaggactggggaaagctgtttgacggctggatttccccggattcctttccgggaagggagaagtctaaaagtgagatgatttcatatgtgatgaagtgttcaggcatgaagaaaagtcaatacgtctatgtcggggatacatggagtgatataaaggctgcacatgaaaataaaattcattgtatcggagtcacatatggagacggagatacaaaaaaactttgtgcatacactccagaacactgtgcacacaatgtttctgagattctaaacattttgaggaaaggagtttaaccatgcttcaggatttcagcatagggattggaacccggtttgtatttggaagagatgcacataaccggataggaaaagaattaaaacagatggggatcagaaaagtcctgattcattacggcagcaggaaaagattaagtgacagcggactcctcggcagtgtcaaagaacagctgcggcttcacgggattcgaatcctggaactgggcggtgtggtgccgaatcccagactgtctcttgtaagagaaggtattcatctcgccagaaaagagaaggtggatatgatccttgccgtcggcggaggcagtgtcatcgattctgcgaaagcaatcgggcttggagccgtggcggacacagatgtgtgggatttttttacgggaaccgaagttcccgggaaatctcttccgacaggtgtgatcctcacctatccagcggcgggaagtgaatccagcgaagtaagtgtcatcaacaatacggagcttggcatgaaacttctggcaagtcatccggtcattcgtccggccattgcatttatgaatccggagctaacttattcactcccgaaatttctgactgcatgcggggtgacggatatgttctcccacgtgtgcgagagatattttacgccggatggagaggtcggagtgattgacagaatggcagaaggaattctcaaaacattggccgagattggaccgaaggttcttgcggagccggacaattactcttaccgggcagagatcatgtggatcagtacgatcgcacataatgatacggtgggggtcggacgggtacaggattgggcagtccacgagatcggaaatgaactgagtgctctgtatgacactccccatggagccacactttctattatcatgggttcctggatgagatatgtatatagagaagcaccggaacggtttgcccgctacgccggagaagtattcggtgtgaaatggaataggaagaatacgctggaggccgcatacgaaggaatcttaaaaacagaagaatttttccgcacaatgggaatgccggtgtcgtttgaggagtttcaggttccgacagacggggtggaacagatgcttgaccggattgctttccgcggggaagatgacagcattggaggcataaaaagactgaaccgggatgactgccgaaaaatttatgagacggcattaaaatcccgaagaacaacgagtgagtgagggaattatgaaaatacttaattttggttctttgaatattgattatgtatatagtgtgaaccattttgcagagaagggagagactctttcttcagaatcactggaagtttttcctggaggaaaaggactgaatcagtccattgctctttcaagagccggaggagacgtttaccatgccggagtgatcggcacggacggaaaattcttgggagaactcctctgcgacgccggtgttgataccagatatttaaaggtaagcgaggatgtccggacaggaaatgcggtcattcagaaggacaaaaacggagataactgcatcatattgtacggcggtgcaaatcaggcggtgacaagagagacggcggatcaggtactgaaaaattttgatgaaggcgactgtctggtcctccaaaatgagatcagtgagattccatatattgtagaaaaagcgagagaaagaggaatgcagatcgtcctgaacccatctccgatgaatgaaaaaatattcgagataaacttggaccatatcgactgttttatactgaatgaagtagaggcgaggatccttgtccgggctgcacgggatgccggcaaagaaatattattgaagcggctgagaaaacaattcccgcacgcggagatcattctgacactgggagagaaaggctctgtgtatgccggaaccgaggggacggcagtgcagaaagcctataaagtgaaggcagtagataccacagcggcaggagatacatttacgggttatttcatgtcctgcatattacaggggaaatcagtgaaagaatcacttgatatggccgcaaaagcgtctgcaatggcagtggctgtaaaaggtgcggctccgtcgatcccaaaaagggatgaggcagagaggtttgcggaagaataaacatattaggaggaaaccatgaaaccgagaatagtaatcattgacacagaccccgggattgatgatgcggcagcgattgctgtcatgctgtccgagccgtctgtggatgtaagactcatcgccagtgtatcaggaaatgtcggcatcgagcatacgacaaataatgctttaaaacttcttacattccttaaaaaagatgttccagtggcaaaaggtgcggcggctccgcttttgagggataaccgttttgcaacgaatgcccatggacaatcaggaatgggcggatttgaattccctgaacctaagaaagaacttttattagaagagaatgcagttctgagtgaataccgcatactgaaagaagccggggagaaggtgacaatccttactcttgggccgctgacaaacattgcgctgctgattcagacatttccggaagtgaaagaaaaaattgaggaaattattatgatgggaggttccaccgagagaggaaacattggaatctatggagagtttaatgtgaccattgatccggaggcggcaaagatcgtattccgctccgggattccgatcacaatggtaggcctggatatcggaagaaaagcaaggctgaccgcggaagatctcgaggagcttgaaaagagcggggaggcaggaaccatgatcagctctctgtttcgttcctatgacggcggacatgtggaagagggagtcaagatgtacgatccttccgcagccatgtatctcatggagccggagctttttgagacaaaagaagcgtttgttgatgtagagatctccagtccacttacgatcggcgctactgtcgtggactatgacggtacattgagtgagacaaaaaatgcggctgtgtgcgttgacgtcgatgtggagtgtttccgcagacgctatgtggagcgggctgcaaatatcaaatgttaagaaacaatatgaaaaagacagttgaaaggtatggtatgaaaaatgtctaatacgaatttgaaaacaacaggtattccggtaccggcagaaggaaccccggaatttgaaaaaatgaaccgaatggcaaaacgagcgattccgctggtgctgatcatctttattttcggcattcttgaacagcaggcattcggaatgatctttgtaaatatcggacagcagctgggaacaccggaactggcatctctcattacatctcttccgggaatcgcactcggtatcgtctgtgtaatctatggatctctgggtgactttgtgtctctgaaaaaaatgacacttttagggacgattgtgtttgccgccggctctgccattggatttttattaggacctgtgagtatctgggcggttgtagccgcgcgtatgctacagtccataggaggacaggtggcaggctctgtgttcttagtccttgtgtccaaatatatttctcagaaagaacgcgtcgtctactatggtatttttgtagcggtattcagattctcagcggcccttggtgtagttgcggccggatatgtgacaaaaatagactggagatggatgtttgcgattccgatgatctccatagtatttcttccggcactttcaaagaaccttccggatgaacacgcaaaaggcgctaagatcgacggctggggctttactctgatcggagctttcgcaggggccgtcacaatgttctttacagatatgaatatgctctggactgccgcaacagttgtgactctggtagcgttcattgtgtacatcaataaagcccaagacccgatcatcactcctgcctttttgaaaaatccggcatttgtggcgacgatggttgtcatcttcgtaggttactttttcagctatacactgaatgccggtgtgaatgccatcggacttgaagtattcggcattgattctgctcaggtttccaacctgctcgtctggtccatcctccttgcagcagtgcttggattcgtgtgcggaccggtcatcaaaaagatcggacgttccgcgggaatcatcatggctctctctgctatgggactcggtctgatcgccattgcatttgcgattccatacggtaaggttgcagctctggcggcagcaccgtgtatctattatttcggaacatctttcttctactcaccgatcgtagataccgcgacacttacggtatcaccggaagagtcaggacgtgtgctggggatcaacgaccttgtccaggcgatcacagggtctgtcggtgtggcggttttcggacagctcatgtcaaaaggcgctatgtcaggcggaagtattacaggggttgaggccggcgctgcctccacatatgcaaatgtgttccttgtaggcggtgttatcgtgcttgctgctttggtgatcttcattgtgacgaagaagatgatctacagccgttcaagaaaagatgatgaataaatttaataagtaagaaaaacagaatggaaaatatcaaaagacaaggatatttttcattctgtttatttgggtttttactactatgtatctctataaccaaagaaatgatacaacgatagttttttatcactattggaggaacgcatttcaaagcgtgacggaaatagtgataaaaaactcatgagatcctgactttgattcctttgctttccagttctgacttggaagcttcagaaatttgatcatcggtaataactgttttgacctgttcctttagatttaggggaacgattccgtgtttggaaaacttatcactttctgttaacacgataacttctcctgcctgtacggccatatctcgcacagcttgtgcacgcatctgatcccgatttgtaaagcccacattgggggcatatccgtctgttccgataaaaaacagatctacaagaaagttttctacgcagggacggatcatcggacctaccatgacttgggaatcctgctgataggtgccgcccagaagaataatctgaaaatttgatttcccacggatatgctctgcgataaaagcactgttagtaataattgtcagatctcttttggacgaagccagttcatcagctaaaagagcacagcagcttccgctttcgatcataaccgtatcgccatcgcagacaagttcagcagccttttttgcgattttccgtttcgcctcataatgataggcgattctcccattaatatcatctgtgctgcataagagcgcaaatccgtgttcacgttttatgattcctttgcgttccagttcatctaagtcttttctgacagtaacctgtgaaacaccaagtttttcggaaagaagtgatacttcgattttgttcttctgggtaagcagttccaatatcttatttgttctgtttttcatatgatgactccgttcgtatcgtatactgaaaatttatacccaaagggcatcccgtgtttcatacccttcgggtggacgtgcttcgcacgataaggtatgatattttatattgctttttagtataccacaaaaaattatttttcaatagagtagagttacgaatgaaagaaatttatgtttaaaaaaacgcatcaatgccgcaattaataaatatctgaagataatcctgtaaatcttccctgtgaatagacggtacattctggtaatcatatgtctgatccaataagctgtatttgttttcgccaaattggtggaaaggaaggagctgacattttttggcccctgcttcctgcaaggcgtttgctaatccggcggcatcttccggggaattattaaatcctggaatgacaggtattctgggcagcacttcttttcccattttaatggcgcgcttcatattggaaacaggaagatcgttgccaacaccggtaccctctatatgttttgcggaattccagtgtttcatatcgaacagtatataatcaagattttctataacacggttaaagatctccggatcagcaaatcctgttgtctcgcagcaggtatgcagtcccttttctttagaagcaagcagcaattcttcggcaaagtcgggctgagaaagaaattcacctccggacagtgtaataccgccgctgctttcttcataaaaaactttatcctgcatgaccacatccatgacatcctgtacggtttttatatctccttccaattctaaagctttccccggacactcaagtacacactgcctgcatccggtacacttggctgcatttatatggatatgatcatgcttcaaagaaattgcctgagcagggcatatatccatacagtgatgacatctggcgcattttttttgatcccataatacctgcattttagccaactggctttcagggttagagcaccagcggcagcgcatgggacatcctttaaaaaacacaaccgtacggatgccggggccgtcattgacgctgaacttttgaatattaaagataacaccggtttttgtataatctgcttttttcatgataatctcctttactgataagatcatatcatatttgtttcaaattgaaaatgaaaaatttcaaatgaaatgtaaaaggattttatactaaaatcatcttgactttttgccggaaaagaattagagttaaattgcaaataaaacaaataataattacgagtgaaattaaaaggagaagcttatggaaaacaaagcgcattttggatcattaacagacagaatgagaactttccgtgaagaagtcttggatgaaaaaccttacattgatgctgagagggcattactggcgactcaggcttataaagagaatcagaatcagccgcgtgttatggtaagagcacttatgttgaagaagattttggaaggtatgacgatttacattgaagacaaatctctgattgccggcaatcaggcgaccaagaatacaaatgctccgatttttccggaatatacgatggaattcgtcctgaacgaattggatctctttgaaaagagagatggagatgttttctatataacagaggagacaaaacaacagctccgtgagattgctccattctgggagaataataatctccgtgcaagaggtgaggcgcttcttcctgatgaagtcagtgtttttatggagaccggtgttttcggtatggaaggaaaactaaatgcaggagatgcccatctggcagttaattatggcagacttctgtctgagggattgaaaggatatgaagaaagaacaaaggctctcaaagatgctcttgacttcactgatccggagagtgttgataaaaatgaattttacaagtctgtcttgattgtgattgaggcggttcatcattttgcactgcgttacagcaggctggcaaaagaattagctgataaagagaaggatccgaagagaaaagctgagttggaagagatgtgcagaatttgttccagagttccatatgagccggcatcctctttcaaagaggccgtacagtctgtctggtttatccagctgatcctgcagatcgagtcaaacggacattccttaagttacggaaggtttgaccagtatatgtatccgtattataggaaagatattcaggacggaacgatggcagaggaagaggcggaagaactccttacctgcctgtggatcaagacactgaccatcaacaaaataagatcccaggcgcataccttaagttcagccggttcccctatgtatcagaatgttacgatcggcggacagacaccggataagaaagatgcagtgaatgaattaagttttgcagtacttaagtctgttgcacagacaaggcttacccagcccaatttgacggtacgatatcatcaaaatatcaacgagcagttttttgacgaatgcatcgaagttatgaaactgggattcggaatgccggcacttaacaatgacgagattattataccttcttttatcaactggggtgtcaaagaagaggacgcttataactacagcgccattggatgtgtagagaccgcagttcccggcaagtggggataccgctgtactggaatgtcttatattaatttcccgagagttttgctttgcgctatgaacaatggcgtggatctgacaagtggaaagagatttacaaaaggctatggctattttaaggatatggactcctacgaggatctgctggcagcatgggacaaaacggtgagagaaatgacacgttacagtgttatcgtagagaatgtcattgataaagcttcagaaagagatgtaccggatattctttgctctgcgcttacagatgactgtatcggaagaggaaagaccatcaaagaaggcggagctgtttatgattttatttccggtcttcaggttggaattgccaatatggcagattccctggctgccattaagcagcttgtttacgaagaaaagaagatcacaaaagaacagctttggaatgcaatccttgatgattttcagtctccggagaatcagaagatccaggagatgctggtcaatgacgtaccgaagtacggcaatgataatgactatgtagatcagctggtcattgaagcatatgattcttatttagatgaaatcaagaaatatccaaatacccgttaccagcgagggccgatcgggggaattcgttatggcggtacgtcttccatcagtgccaatgtgggccagggtatgggaaccaaagcaacaccggatggaagaaatgcatttgaacctttggccgaaggctgcagccctgcacataatgcggataagaatggtcctacagcagtgtttaagactgtctctaaacttcctactgaaaagattaccggaggtgttttattaaatcaaaagatgacgcctcaaatgctttctactgaggaaaacaagcagaagctggaaatgcttatccgcacatttttcaacagactgcacggatatcatgtacagtataatattgtgtcaaaagaaactttgcttgatgcgcaagaacatccggaagaccataaagatctgattgtccgtgtggccggatacagtgcattctttaatgtactttctaaaaagacacaggatgatattattgaaagaacagagcagacactgtaattgaaaggaagatttaccatgaaattaatgattgatgatgcgaacatcgaacaaaaatttacgaatattatccgatggatggcgtgactacgaatccatccattctggctaaaagcaaaagaagtccttatgatgtactcaaagaactcgcaatgcaggaattaaagaaagagggaattaaactgacagcaaccgcagtttatacaccgatgcaggcgttccttgcagcaaagagcggagcatcctacgcagctccttatattaaccggattgataacatgggatataacggtattcaggctgcaaaaaaatccatgatattttcagaaacctttgtgagatgcttccagataagcgtttctgcctatagttgttctattcaaagtgaaaacaaaaggcggcaggttgacaaaaaagattcaacacaataaaataatagtaaacaatataaaataatagccacacggaaggatgagatcatatggtcagatttgcagtaatcggaacaaattttataacagacaatttcatggatgcggggagccaatgtgagggctttaaggtccaggcagtgtactcaaggagcatggaaaaggcaaaagagtatgcaggaaaatatgggatcgaagattgctatgattctcttgatgctctggcggctgcagaaaacattgatgcagtttatgtggcatctcctaatgcactccatgcaggacagagtataaagatgctgaaagccggcaagcatgtcctgtgtgaaaagaccattgcttccaattccggcgaattagagcatatgatcaaggctgcaaaagaacatcaggtcatcgttatggagggcatgcgttccgtatttgatcccggctttgcggcgattcgggaaaacctgccaaagctcggaaaaatccgcagagcaacattccagtactgtcagtattccaggaggtatgacaattttaaaaaagggatcatagagaatgccttcaagcctgagctttccaacggtgctttgatggatatcggcgtctactgtgtgcatccgatggtgaaactgttcggactccccaatgagatctcggctcactgcctgaaactttccaatggagttgacgcctccggtacgattgtggccatgtatgatgaaatgcaggcggagcttatgtactctaagattacaaattccgcacttccaagccagatccagggggaagaggcctccatgatcataaaggaaattccggatacgacaacaatcgagattgtgtaccgcagcggagaaagagaagagatcaaaatagacaaaaagaccaacaacatgtattatgagatagaagaattcattcggctggcagaagcaaaagaaagtgctgagatacataatcaatactctatattggagttgaaggtcatggatgaagcgagaaaacagatgggaatcgtgttcccggcagaccaatagggaggaagttatggaagatattaaaacattaattgatcagattagcgaggagcagaaagagcttgtcctgaaatcgttcacaaacgaagaagcctgcgcactgggtattgagatgtaccagaaagctttgagagagaacaaacctattgtaatatccattacaaagaacagaaagcagattttttatgcggcactggagggcacgtccaagaacaacgaagactgggtccgcagaaaagaaaacacggtttatgattttgaaaaaagttcttacgagatgaaactgtctatggacctcaaacaggatgacctgtggaatcggtatggtctggaaaaaggcgattacgctcaggcagggggaagcattccggtcttcgtttccgggacaggcatgatcggaaccgtgaccgtatccggaatggctcaaagtgaagatcacgcctttgtagcagaggcattaaaaacgctgaagtaaaagctgttatttctataataaagaataaattcagtaaaatcaaagtaggggactgctgtggcatgacggagaaatcggttatgtacagcagttcctttgttatttttttaagatcacaatatcgtgataatcaccggattgaaggccttttggcttaattgtatgataaaatagaagctgaacacagatgaaaatacgggaagaaggtgcaaaatgcagaagatattgatcgtggaagacgaccgggaactgaaccggacgatctgctatacgctgaaaaaagaggggtatgatatatattcagcgtattcggtttgtgaggcgaaagcaatatatcgacaagaaaaaatggaactgattttattggatgtcaatctgccggacggagagggattttctctttgcagatggatgaaaggacagagtgaagtcccggttttgttcctgacagcgagagatctggaggaggatgccctggagggctatggttccggggcggaggattacattacgaagccgttttctatcaagatcttaaaagaaaaaatccgcgtggttttaaaaagagaaaaggccggcagacagaatttctttgacgatggatttttaaagattgattttgagagggcaaaggtagaggcaggcggaaaagaatgtacagttacccctacggaatttcggctgcttcgcctgtttgtcctgaacaaaggacagcttctgacctatgctgtattacttgagcgcatttgggacaatggaggatgcttcgtggataagcatactctggcagtgaatgtaaatcgtctgagaaaaaagatcgaggacggagagcatcaatatatttctaatatttatgggatgggatatcaatggctggaatcatgacagcagcggcatgctgcctttttttcgtatcggtttctatgggaataaaaatgtggaagttaaaacgggatatttcctcatttaccgaccgcctgctccgatgtctgaacgatatgacctgcggcagggaactggaaagattaaatgaagaaggagatactttgtgggataaagtatacgaaaagcttcagaagctggagcgcatctggaagcgggaaagcgcggaaaatctggaagagaagaaaaaaatcaaaagcctgatctcagatatttcccatcagacgaaaacccctattgcaaatatcaagctctatgaggaggttttgctggatgaaggactgggcacggcagaggcaggggaatttcttcaaaaggtaaggattcagaccgaaaagctggattttcttctgcagagcatggtgaaaatgtcccgtctggaaacaggagttatagaagtctgctgtatgaaattacccttgtgcgggacccttctcagagcggtagcggcaatcgtgccgaaagccgagaaaaagcagatacgcctgtctgtggactgcgatgaggacatagtggtaaatcatgatacaaagtggactgaggaggcagtttttaaccttcttgacaatgcggtaaagtataccggcaggggaggaagtgtcgggatcttggtgtctgtccaggagatatttacgaagatcagtatcagagattcaggaaaagggatcgccctggagcgtcaggcagagatcttcacaaggttttaccgggaaccggaagtatatgatcaggaggggatcggtgtgggactttatctggcgagaaagatcatagcactgcaggacggctatatccaggtctgttctgagattagaaaaggatctgattttcagatttacctgcccaacgggtgacagaaggaaagtcacagtactgtgaaattttatgcctgtgaaaggtttgtgatttttatgagttatgattgcagtaataaaagaaaggagataaatctatggaatcgtacatagtagagacacgggcattaaaaaaatattatcagctggggacgaacgttgtgaaagcactggacggggtagacttcagggtgaaagaccaggaatttgtttctatcatcggtaaatcgggaagcgggaagagtacactccttcatatgatcggagggctggatgtgcctacggaaggtgagacgtatgtagacggaaagaatcttgcggaaatgaacagggaacagcttgcggttttccgcagaagaaaaatcggattcatatttcagaattataatcttgtcccggatttaaatctgtatgaaaatgtgaccctgcctattgaactggatggagattgtgtggacagagaattcattgacgagatcctgaatcttctgaaactgcaggagaaaaaagaggcgctgcccagcaccttgtccggaggacagcagcagagggcggccattgccagagctattgcatcaaaaccttcgattattctggctgatgaacccacggggaatctggatactgcttccagccatgatgtgctggggcttttaaaggcagtagcgggccgatttaaacagaccgttgtgctgattacccatgatcaggatattgcacagctttctgaccggatcgttcacatcgaggacggacggatcgtgagaggaagtgatgcgtatgttggagaataataaccggaagattattacaaagatggccatgtcttcgctgaaaggaaacaagcctaagtttgccgtgatgatcatcgctgtcgtgctgtcttcttttatgctgttcagtgtgtttacggtcggaagcacttattttaaaatgcagcagttgcagaatattcatttacacggtgcagattttgatgcagtgctgcagggcggctattcagagcagcagcttaaccggtgcaaaggtaatcaggacgtcagagtggcaggagcaggaggatatgcaggagccgcagtgaaaacagacgcagatgatacactacatactggaatgatctggtgtgatgagacttattggggtgtcatgatgaagcctgccagaaagcgggtaagaggctattatccgaaaaaggaaaatgaactgatggtcacgaaagcagccctgaaggactgcgggaaagaaaatctggatgttggagatacctttgatctgacttatacagaccagaacggtactcacacgaaaaactttcttatttccggaatatgggaaggatacggcgagcagcagctgttctatgtatcagaagcattttataaaaagaccggatatcagctgaataatatgggtgtgctgcatgtaaaatttaaaaataaaatactgacagaagatcagaggacgaagtttcaggagagtattcgtctgaataagcggcagaattttcaatttacaggagaaacagagaagtccgcaggtatctttgcgggaatggcaggtctggtcctggtcacctgcctgagtgcctatctgctgatctataatattttgtatctgtccgtttcggggaatatccgttactatgggctgatgcagaccgtgggaatgtcctcaaggcagatccgccgatttatgaaaacacagatgatgcttataggaacagccggggtgggcggaggaatcctgttcggtttttttacatcctttctggtgatcccgaagattgtgcgaactctcggcatcagggaaagcgcaatccctgtcacatttcatccggcagtcttttttattactatttctattgcgggactgaccgtctatttcggaagcagaaagccaataaagacggcagcttccgttacacctgtggaagcgctgaattatcgtcttacatccgcaaaaaagaaggcgcataaaaccagaaacggcagtcttatatggagaatagctgcagatcagttttttaaggataagaaaaaaacaggaatttcagtgctctcccttgctgccagtctgtctatgtttttgtgtctgatcacgatcattcaaagtcacggagccagaacgatcatgtcaaactatatggatacggatttagtagtcagcaatgattctctgatgaaagaggaagatgaaaaatggaaaccaattcttaaaccttctttggtaaaagaattgaaaaagagcaaagatatccgggaagtacacccgctgctctgcgcaaagatcatcgtcccatgggagccgaaattttcagatgtgtggatgagagagttttatgaaaggtggatgtatacgccttataaagacgatatcaacgattataaaaagcacccggagaaatattattctgtcatgcaggggattgataaaaaggaatttgagtacttaaataagagtctcatacacccggtagatcagaaactttttgaaagcggaaagatctgcatcatttatgggccgggcatggatctttccggtgagattgataaaaaagcaagggtaaaattctatctgtcagaaaataaaaacaaaaagttccagccgagaattgccggcatgaccgatgacagttattacggcagaacttcgggaaagggaccggcagtcatcgtcagtgaatcgtttatgaagaagtatgtcatgaatccgtatatttcaaaactgaatatccggtatacaaaggaatatgacgatgaaacagaagacaggatcagaaaaaacctgagtcaaagtacctctgccaaagatgtgtcttatgaatccaagatcgacagcatgaaagatattcaaaaggcccagggaaatatgaccggagtcggtgtgggaattgcccttctccttgcactgatcggactgatgaattatattaatacggtgtttggaaatatccagaaccggcaggtatctctggctgtcatggaaagtgtgggaatgaccgaaaaacaggtgaaaaagcttctggtcagggaggggctgctgtttgcggcagcttctctgtcattgacggcaacggctggcctttttattacttatcagtactatcagacgatgaattacatgaacattccatttcaaatcccggttgttccggttttggccgccgtttcgtcatccgcggcagtatgcattgggattcctctggctgcatatcggatcattcggggaaagacgccggtggcagaaaggatacgtggatttgactgatgaaaaggaaaaagccagaagaaaagatgaaggccacgaaagaattctgccgcactgttctgctgatatcactggtgattaccatgattttgatctttcatatactgatgatgtaaatagccgaagaattttctgacgtactggatagatcaggtgttagattgcatattttatgttatgataaaagatagtaaaaaacgtacaaggcaatatagacataaaaggagatggaatcatgaatacaacagatgcagaaaaaagaaaaatactggattctatgaaaggtctgatcgtatcctgccaggtagtgcctgaagatccgatttatacagacgatatggtagtcaagatggcagaggccgcacaatgggccggggcagttggaatccgggccaattctccggagcagatccgggctattaaaaaggcagtggatctgccgctgatcggtttgtataagatcagaagaggagacgaagaagtttttatcacaccgacactggaggccgcaaagcaggtctgggaagcgggagcagagatcattgccatggactgtacggaccgaatgacaaaagaaggccgccgtgcatgggaacttgtagcggatgtgaaaagggaaatccctgaggccatgatctttgccgatgtctccaactatgacgaggccaaaagagcggccgacttgggtgtcgatattgtggcgcctactctgtttggatatacggaggcaacaaagcattttgaaacccaggatatgagggcatttgcaaagatgtgccgggatcttggcagcgatgtgtatatgatgatggaagggcatatcaatactccggaagaagcagtgaaatgcctgtatctgggggcacatgcggtggtagtcggaagtgccatcacaaggccgcatctgacagcgaaaagatttgcggatctgatttcggggtatcgggaataatttatgacgggaagcctgctcatggaaattcaacaaaaattccatgggcaggctgtttttgaatgtttagaaataaattttactgaaatttcgattctatatagttctgaataaagtctattcgatccttcgctctgggtttaaacagggaagcaatggctacagtcaggtttttctttctgttgacgtagattacatttccaccgtctcccattgccgcaaagccatcttcgtggagccaccataaatacccataggcaaggttctccttaacccagcggctgtgttccttcgtgctttcactgatccattctgcagaaacgattggttttccgttccacagtccgccatttagatataactgacccaattttgccatatccgcagccgagagggtaaggccccagcctcctgtgtttgtaccggatgggtcagagacccagccgctgatatccgtggctttgttaaatgccagctgttcttccttggaatgaaatacgatgctgcgttctgcggtaattttaagcggtataaataagttttcctgagcaaattcaaatacagactggccggcagcttgttttaaaatacctgtcaaaagatccggtccgatcagaggagcatatctgaattggcctggttttcccctgcctcccagtaaatcaagcgtaaacgttaccatgtcatcgctggtgaagtatttgacgtagggggcaattttgtatttgtacggggctgtcatcgtcagcaaatgtttcagtgtgatattctgtatggttttttctctctgttttgggacgtagtcagggaaaaaatctaaaaccttctggtcaatgtctgtgatgaagcctttgtccatggcgattccgattaaaatagagacaatgctctttgtaacagaatatatatgaacgcggctttcggcggtacagtcgttaaagtactgctcatactgcatttcaccgtcctttaatacgacgatgcctgctgtattgccatagtctttgttgatgatcgcttcaagttctttcatgtcttgctgagttgtcataatttctcctttcatccattggtttatgtgataaaggatatccttaatgtaagcataagttcattaaaaattgtttacaacccctaattttaaaaaaatgagaaaagaattttttattgttccagtaatctgtgtaattctctgaaatcgtcaatggagtattctgggttatccacatggccaaagccataagatgcccatacaaaagagatcccggcttttttcgcactttcggcatctccctttgtatccccgatatatatgggagacttcagccggctgcgctccatgacaagttttatgttttctccttttgataatccggtacgaccctgttcttcatagtccatgatccagggagagagtttgtttcttctcataaacgcacggacataaccgctggggcagttgcttacgataaacaggggatactgctgtgcaagttttttaattgtatcttttactccgggataagtccggtcggtgtgtaaggattcaataagctgtatctgacggtttccgcagtcctccatgagtttgtaccgctcttgtggcggcaggtggggcataaacagatcggcaacttcatttggaggagttccgaatacggaagtcagattctcaagtgtaaagtttatttcgggatgcccctggtcgtgaacctctctggtgagtgccgtagcaatctcatctcttacatcccacagtgttccgtcgatatcaaaaataatgctgtcgattttcatatagcggactcctttctgtttgtttttaatgctattttatatgattttcgtaaattatcaatatttgattgaaaaattgaattttgaaactgaaagcgttcatcttatgattgaatacgatcaatttatttcgtataattgataacaaaaggaggaatcttatgagctttgaagaccgtgaaaggaaaattatccagttagtaaaagagcgaaattatatttcggtcaaagaactgacaaaacttttgtatgtcagtgagccgacgatccgcagagacttgacactgctggataagaaggggctgctgaagcggaaccggggcggcgcctcttatataagcaggcagcagacacaatacccgcaggcattccggcacgatgaaaatatacaggagaaaaaatatatcgcgaggcttgcatcgcagtttgtccaaaatggtgactctgtttttatggatgccagcagctcctgtttttatctggctcaatatatcaaccgggataaaaagttaaatgtcatgacgcatggctttgccgcggccaaggaactggcaaaatcatcaaacataaatgtagaagtcgtatgcggaaaatacgatattttcaatgatgcagtctacggtgcagatgcctgcaattatgtgaggtcccgctatgcagacatctgctttatgtcgatgggcggcctggatgtttcacaggggctgacaaacttatatttagaggatgcggagatcaccagggtatatcatcagcaggcaaaaaaaaccattttattagcagaccatacaaaaataaattgtaaatattatataaaagtatttgatctggcggagatcgacgtattgatcaccgaccgtcccctgccggaagaatttgatactttttgttttgatcatgatatagatgtgatctttgaatagtatgtattaaaatgtttttgaggtaagaacgatgcagatgtcgaatcggattaaagaaataatagaagtgattctgaacagcaagggttatgtgacggttggtgaaatcgcaaagaatgctctgatggtaaacattcttctgaatcatgcagatgaatccactctctaccaatggctgaggagagaaggggatgcatcgagagtctatacagttaaaaacagtattctggattccaaaatccatacattcattgaatatgtggaagaccgcatgggacttcagctgatccgggacaaagaattaaaagaaagcctttatgttcatatagagcgtgctttgacaagaatccggggtacctcacgatgtgccaacgaagagtactcctttaggtgtcattcttactattgccgcaacaggaagtgaggcgtctaacagctgtgttatcacaaaagcagacgaaaatttagaacggttctgtgacaatgacatcaaccgtgccagatttgccattgaaaatccggaacttacgatgaccctgcctccatttcagacggcatgcggcatcattgacatcatgtctcactcatttgagagatattttactcctgaaaaggaaaatgacatactgacggactatttatgtgaggctattttccacacatgtatggactgcggacggattctcatgaaagatcctgagaactatgaggcaagagccagcatcatggtggcatcgactctttcgcacaatggtctgaccggtatgggaagaaccggagactgggcatcccatttcatcgagcatgaattatccggcgaatatcagagcgtaactcacggagcaggacttgcggtgatcactcctgcatggatgaaatatgtgtataaagacaacagggacaaatgttcttcttaagcctcggtgttccgacaaaattaagggatgttcccggagtcgaggacttagatgaagaagtgatggagcgcatggcgaaacgtgtacgcgttgttcatgaggacggaagcatcggctgggtgcgccgcttaaatataaaagatattgtagaaatatttaaactggcgatgtaataaaagaagaacaaagtgggcaagcccacttcaacgccccaacccctccctcactctttgaggggcttgacaactttgcgtgcctgatgcaatttgccgcaggcaaataatttccttacgcatctgtgcacaacccgcggagcgtttttatttcatagggaaggtcctgtgatttcatttgaaatacagtttggagagaaagttttatacttattttattgataatcagtcaaatttgacatataattaacagtgattgataaaattttaaccaaaatgcacaatgtgaaggaggtatctcatgttaaaccaggcctactatgacaaaacagatgagatcatagcatctcacgggcttacgcaggctgctttgatcccgatcatccaggatattcaggcagaatatcgctatcttccgccggagcttttaagttatgtggcatcaaagctgtccattgacgaagccaaggcgtacagtgttgcgaccttttatgaaaacttttcttttgaaccaaaaggaaaatatatcattaaagtctgcaacgggacagcctgtcatgtccgcaaatcagtctccattttggaacgtctttacagtgagttggggctctcagaggagaaagcgaccactgatgatatgatgttcacgctggagaccgtttcctgtcttggcgcctgcgggcttgcaccagtcctcaccgtcaatgacaaagtctatccggcgatgaccccggatgctgctgctgaactgatccgtgaactgagaggagcttaaatgatgaaaaaaattgaaaacagagaagttctcgaacagatccgtcaaacttccagggagcagatgaacaaaagcaaatgccgggtcctgatctgtgcaggtacaggctgtctttccggcgggtcaggcgccatctatgacaggatgtgtgagttagtgggggaacatcctgacgtagaagtccatttcggaccggagattgcacacggagacggtgagatcggagtgaaaaaaagcggatgccatggcttctgcgagatggggcctctgatgaggatcgagcctcagggaatcctatatacaaaggtgaagcttgaagactgtgaggagatttttcacaggacgattgaaaagggagaaccgatcaggcatctgttattcaagagggatggaattgaatatcagaggcaggaagagattcccttttataaaaaacagacgagaaacgtattaaaaaactgcgggcatattgacgcagaacatatagaggagtatttatccatcggcggatacgaggctctggaaaaagcactgtttgacatgaagccggaagaggtggtcagcgaaatatcagagtcgaatctgagaggccggggaggcggaggcttcccaacagggtataagtggtcccaggtagccggacagaaagagaaaatccgctatgtcgtatgtaacggagacgagggggacccgggtgcatttatggaccgaagcatcatggagggagatccccacaagatgatcgaaggaatcatgatcgccgcctatgcggtaggcgcccgggaaggatatatttatgtgcgggcggaataccccctggcaatcagccgtctgaaacgggcaatagaacaggcggaagaatgcggacttctgggagaacatattctgggaactgatttttctttccatttacatatcaataaaggagcaggcgctttcgtgtgcggagagggaagcgcactgacggcatccatcgagggcagccgggggatgccccgggtaaaaccgccgagaaccgtagaacagggcctgtttggaaaaccgacggtgctgaacaatgtagagacgttcgctaatgtaccgatgatcatcacagaaggcgcccagtggtttaaagggatcggccctgagaaaagccccggaaccaaggcgtttgccctgacaggcagtgtcaatcacacaggcctgatcgaggtgcctatgggaacgacgctccgggaagtgatctatgatatcggaggaggaatcaagggagacggagaattcaaggcggtacagatcggaggaccgtccggcggatgcctcatcacaccgcacctggatgtgaatctggactttgactccctgaaaaagatgggtgccatgatcgggtccggaggccttgttgttatggatgacagcacctgtatggtggaagtggcacggttcttcatgaattttacccagaatgaaagctgcggaaaatgtgtcccgtgcagagaaggaaccaagcggatgctggagattcttgagcggatcgtggagggaaaaggaaagcctgaagatctggaccttctggaggagctagccacgacgatcacagagacggcactctgcggattgggaaaaagtgctgccctccctgtcatgagtacccttaagctgttccgcgatgagtatgtggaacatgtggtcgacaagaagtgtgcttctcataactgcagtgccctgagaagatttatcatcagcccggaacgctgcaaaggatgttccaagtgtgcaaggaactgtccggcagacgccatcagcggacggatcaaagaaccgtatgtaattgacaatgataaatgcattaagtgcggtgcatgtgagagtgcctgtgcgtttggtgcgatccatattgaagggtaggaggagaagaacatgagttatatgacaatcaataacagaagagtagagttcacagatgaaaaaaatgttttgtctgtcatccgcaaatccgggatcgatcttcctacattctgctatcattccgaactttccacatacggcgcatgccggatgtgtgtggtggaagatgaccggggtaggatctttgcatcctgctctgagacaccaagagacaaaatggtgatctatacaaatacaccgaggcttaagcatcacagaaaaatgattattgaacttttgctggcctcccactgcagagactgtactacctgtacgaaaaacggtgtctgtgtcctgcagaaattatccagacagctgggaatcaaggaggtgcgctttgagaacaataaaaagcagctaccgaaggatctgtcttccgaatgtatcatccgggaccctaacaaatgtatcctatgcggagactgcgtgaggacctgcgatgaaattcagggcatgggaatcctggacttcgcattccgcggatcaaaaatgcaggtgacaacggcttttaacaaagacctggcacaaacggactgtgtgggatgcggacagtgccgtgcagtctgtcctaccggagccattacgatcaagcaggacattgaaagagtttgggaggcgctgtctgatccgaaaatacgggtcgttgtccagattgctcctgccgtgcgcgtagccgtgggagacaagttcggaatcccgaaaggagaaaatgtactggggcgtcttgtggccgcccttagaaggatcggattcgatgaagtctatgatacaaacttcggcgcagacttaacggtcatggaagaatccaaggaactggtagaacggcttgaatccggagataaccttccgttattcacctcctgctgtccagcatgggtgaagttctgtgagaacaggtatccacagttcaggaaaaaaatttcaacgtgccgttctcctcaggaaatgttcggagcgctgatcaaagaagaggcacgaatggatgaggcaggcgactcaaggaaaacagtggtcgtatccatcatgccgtgtaccgcaaaaaaagcagagatcacgaggccggaacatttcaatgaaggggaacaaaatgtagattatgttctgacaacgaccgaggcatcccgcatgattcaggagtcagggattgacctttctcaggtagagccggaggctttggatatgccgtttggaatctcctccggagccggagcaatcttcggcgtgaccggaggagtgacagaggccgtcctgcgccgcctgatgaacagcgaccgggcagaagatctggaggccatcagctttaccggtgtccggggcgtggacgggattaaggaagcttccgtcaagctgggagacagggacgtaaagatcgcagtggtaaacggcctcaaatgtgcctccgaggtactggataaaatagaggcgggagaaatatactacgactttgtggaagtcatggcttgcaagagaggctgcattaccggcggcggccagcctgtgccgatcggaccgaggacaaagaaagccagagtagaagggctttataagattgataaattggcccagatcaagctttccagccagaatccgatcgtggcaactgtttatgacggtattctgaaaggaaaggaacacaagctgcttcataatgaaagatagctgagactgtcattgttcgtatctttcctgcctggtaaagtttatgcaggatggacggaagcaaactggtcttgaagtagtatctttgaaaagatatcataaaggcagaacaagatatcttttttaagagaggagcggaatactatgaatatagatatgacaaaattttctggaaaatgcagctgcggaaggaatcataagctgaccgtaaatgagatcatcctggaggaaggtgcactgcagaggataccggagatacttcagaaagatccttatatagggtatcatagttttgcaatggtctgtgacgagaatacatatgaggcggcaggaaaagaggttgaggcacttatcaaaggaattcagatcatcaaattggaatctgaaaatctccatgcaaatgaagtcggtgtcaataaggtacgggaagcattggaacagatgaaggagaccgactgtctggtcgcagtcggctccggaacgattcacgatctgacaaggtatcacgcctatgaaaaaaagataccatttatctccgtgcccacggcagccagcgtagacggatatgtctctaccgtagccgccatgtcctggtatggatttaaaaaaagcatgatcgctgtttctccgatccttgtgattgctgacagccaagtgatcgctcaggcaccgatgcgtctgacagcctctggcgcaggagatctgcttggaaaatatacggcgctggcagactggaagattacacatcttttgaatggggaatacatctgtgacaggatttgcagcatggagtatgaagcacttgataatttaaagaattcattggaagggctgaaaaacggcgaaattgcagcatatgaagaactaatgtacggactgctgctgtcaggattggctatgcagatgacaggaaattcccgtccggcctccggcgcagaacatcatatggctcatttctgggaaatggcagtgatcaatgaggaaattagcgcgtatcatggagaaaaagtcggagtcgggcttattctggccggcggtatttatcataaggcagcatcatatttgaaaaaaggtgaattttgtatcaaagatcatgtagatgtagagactggtctgatcgaggtaacatttagagacagagaactgtgtgagagcatcaaaaaaactaatgatccgaaccttttggacagcatacatcccgatctattgagtgaaaagacgaaagagatcattaaaatcatcgaagagatcccagaagcagaggagattgaggatatgctccgaaaagtcggcggagttaaaagtcttgaagagttgggctttgatccgtctatgaaagaaaaaacggccagaattgcgccgtatatcagggaccgtgttacatacttgaggatactgaagttttatgatttctatgatcagataataaagtaagtttaagtgggggccgcagtgattgcggctctttttttatttcataggaatgttctacgaccttccctatgaaataaaaagcgctccgccaggatacacacagacttgcaaagctggttagattttgaacaaaaccacggccctgttttttaccagatagtaaaaaatactgtcatccatgaggtaaggcttttgtcttgctggggtaaagtgtgaacgatatactaaattcatacctgcaggacaacagttaccgtaaacgtaaaaagagatccatttcataaggagattaaaatggtgaacaaggtgaacagtataaaaaaagagatagttttatatgcaaaattattagattccaaagggctggtcaatacacttgaaggaaatatttcaattctggaccgtgaaaccggagaattatatattacaccttcagggacaagaaaagccttccttgatgaagatatggtggcagttgtaaaggacggagaacagatcggaggaagcgtcagccgctccagtgaatatctgctccatgaggccgcattaaaagccagacctgactgcagcgcagttgcacatatccatgctccttacttaacagcatatgcgtactgcaacaaaaccatcaggttaaagtgttccaccacattttctctggtgtttgaagaaattccctgtctgccgtatggagaggcgggcactgtacatattgcagacgggattgatgaggcaatgaaagaacatgatctggtcctgttgggaaatcatggatgtgtagcggtaggcaatacgctggaagacgctgtaaaaataattgaggctgcagaagaagtattaaaaattgcgaaaattgcaggcgaagtcggaaccatcacagatattccggatgataaattagaatccctatttgaacatcatcccgggagcagaagaaacagattaaaaaacagaagggagatgtaaggatgaaagcagcagtgatgtacggaccaaatgatatcagagtagaggaggttcaaaggccggagtgtccggcaggcgggcttttattaaaggtaaaagctattgggctgtgtggttcagatattagaaatttaacaacagattcaagaaaaggagattatcctcacatttatggacacgaggttgtcggtgaagtcgcagaagtttcgccggaggctgatacatatgcagtgggagaccgtctctatgtttatcctgtggaacattgtctgaaatgtgaagcgtgcaggagcggccacagcgaaaattgtgaaaatgcaggagattacgcgaaccgtcagggaggatttgcagattatctgccggtgccgccggagcagcttaatgcggatgccgtatatccaatcccggacggtgttgactataagagcgcatcgctgggagaaccattatcatctgtctatgcatgccaggagaatataaatgtcacacttggagacacggtggtgatcattggggccggtccaatcggctgttttcattcacaattagcaaagatccgcggggccggaaaggtaatcatggtggagattaatgataaacgtttagaaacggcaaaacagttcggtgtagactatacagtaaacagtacaaaagaagatccggttgaagctgtgaaaagattgaccggcggcagaggagcggaaaaagtgatttcagcaaatccgtcaacggctgcccagtctcaggcagtttttatggcaaaaaaaggagggatcatcgtatttttcggcggagtggccaaaggtgcggtgacagagatcgattcaaactatatccactataacagtctgtggatttacggacattacggagctaacagcatgcaggtacagaaatcctatgagctggcaatctctgatgcatttcctacggaaaaatttataacgcatgtactgcctttaagtgagatacaaaaaggtattgagttaacaaaaacaggagaagcgatcaaagttgtattgcttccaaacgaagaagaataggagacgaatgttatggcaaaagaattaaaaatattagtagcatgcggaagcggagtggcaacttccaccgtagcacaggaagctgtaaagaaaatctgcagggatgcagggattcccgcaaagatcattaaaagtacgatgacagaaattccggctaaacaggcagatgtagatattgtcatggtgacaacaaactaccggcagaaattggataaaccgcttatcaaagtgtttgggctgatctcagggatcaatgaggataagatcagagacgaaatcatagatacatgtcacagactgcagaatgaaaactgatgatcatattttagaagagataggaggaagaaggtatggacattttattaaaagcggtgcaggctctgttaaatatgggcgctgtggcattgctgccgatcatgatctgtattttaggacttgtgttccgaatgaaatttggggcatcgttaaaagccggattaatggtaggaatcgggtttcagggattaagtttaacagtagggctgctgacgacaacaattcagccaatcacggaatattatcaaaaaatgggaagcggttttactgctgcggatattggatttgcagcggtgggaggtgcgtcgtggacagtgccgtttgcaccgatcgcagtgccgctcattgtaatcgcaaactttattctgcttagagccggactgaccaaagtgctgaatgtagatatatggaattatattcatttcctgatccccggagcattggcatacgcattatggggaaatgcactcctgggacttgccatcacggtgggcctttccatagctgcactatatgcaggccaggcaatcgcacatcattggcaggatttttttggacttgacggaactacctgttcgacgctgtcctttactacatttatgtatccgctgtcatgggctgttaataagctggtcgaccatatacccgggatcaaagatattgatattgatatgaagaagctggaagaaaaattagggttcttcggtgatcctgcttttgtaggattgatcgtaggcatctttttgggactgcttacaaggcaggcgccgacaacagtctttggaatcggtatggggattgcgagcgttctgatcttgatcccaagaatggtatcaattatgatggagggacttacaccgatcggaaatgcggcgagtgcatatatgaaaaagcatatgggtgaagatgcagaattatttatcggcatggatgtggctttagggctgggtgatccggcgtgcattacatgtaccgctatctgtattccgattacgattttatttgcatttattattccgaacatggtgtacttccctattggcttactgggaatcgtatgctacacaacagttatgtgtgtgctggccagcaaaggaaatctgctcagaagtctgatatgttcaattacatctatgtttttgatcacattctttgtcaatatgtttgtgccggagtgcacaaagatgctctctgtgacaggactgaagatacaggggcttgtagcagacggttcatttggctataacctgggtactgtgatcatctgctttatcagtaaattatttggaatgtagagacggaaaaaacaaaggagtgaccgcagtgagttcaaaaaatatatacttggcgacagaaggaagtgcaaaagactgggaagaagcgatatggctttgtggaaaatgtatgatggagaatggaagtgtcagcagatcatttacagattcctgcattgaaagagagaaagagtatccgacaggtctgccggccggcataccggtggctatcccgcacagtaaggcggaggggattaaggaaaactgtatctgctttttgagattagacaaaccggtccggttttaccggatggatgacagcgaagagtatattgatacgagattagtgtttaatctggcaatcaaaggagcagatgatcatttagagtttctccagaaattaatgcagtttgtactggatgaaggcagcctggaaaaatgcagcaccatgaagctggaagatattacgaaatttctgcagacaaaattaggataaacttaaaaaggaaaatgacattatagaaagacatgatctataatgtctctttcttttcttttaaattaggaaagtgatatgtgatgaaacgacgaagcactgagattatgcagggaattttgaagtccaaagaagacgatgtatcggcaaagcagtttatgtcccggtatgatatctccaggagaacattgaagaatgatatcaatgagatcaatgattttcttaagacaatctcaatgggagaaattttcataacagaggacggaaacctgaagatcggaggactgttcgacagagaaaaaattgaagagcatttatatcagatggatatgtatatgtataagctgtcaccggaagagcggcagatttatattatgcttgaattaatcgcaaatccccattatacaacgatgcaccggtttgcagaggaactttttgtaagccgtataacaattatgagcgatgttgacgcaatgaaacagattttaagaaacagcgatgcagaactcatcctggacagtggaaaaggaattaaattatcatgcagctatgaggcatctttggagctgcttgtctcactatacaaaaaaattgcggtcaacattaaaaatgatggattttttcagagaatgatgcttaagaaaatgaaaattaaatatacgttctctgaattattttcctatatgcaggattatatgaaaataaacaatctggtttttattgaagacatcttttatgatattgtcttatatttatttacagcctttaactttcgggaacgggatcatgacgaagcagacaaagtggttacagaaaggatgaaattaacaaatattgatcatatgatgctctatgcaggatatatgttagacgttccggttacagaaaaaatgatcgactgcttcagagactatattgagaaaaataatttatactcgtttgtaaagacagtagacgaagttgagctttataaggtcatcatgttctttgtatcaaaaattgatcaggagctgcgtttagaattgaccaatgatgacaagctgattgattcacttttgatgcatattaaaagcatgaaggattggggaaactatgaagttgaaattcctaaaaattatgacctgcctatgaactatgaactgctggagacattagtagagaaatattcttatattttagaatcctttttatcttataagctgagcagcaacatgaaaaaatcaatcgttattcatatttgcgttgctgtcatccgaaaccggagatattatatcccgaaactttccattgtgatcgtatgtccgggaagtatggctaccggaaaatatctggaagcacaaatcaagaactattttgattttgaaattgtaggagtgcttgcggcaggtgaagtcatcggtgagctggaacagatggagaggaagattgattttatcttatcgacggtacatattgaagcagacgagtataaggtaattacagtcaatccttttttgactatgagagatttgaatctgatccaaaaggaagtgtttcaaagccagaaacaaattaatctgccaatagaaaagaaaaagaaaaaattactgggggatcttcaggatttaatggatgatgataaattatcagcggaaacttacgataagattgaagcaatccttatggagatgaaaaaacctctaaaaaaagaaaatgctatggcagaacttttgaaaaaagacttcattgccatcaaaacggcttcctgtcattggaaggaggcaatcaaacgttcggctgaaccgcttgagcaatttgggtatatagaacaaaggtatgcggaagaagcaatacaaaaggtagaagagtacggagactatattgtggtaagccggggggttgcattggctcatgcaggaaaagattccggtgttataaaggatggattaagtctgctggtctgtaaggacggaatatcatttcaaaaggataaagctaaggtgaatcttatcttttgttttgcatgtacaggcgagaaagagtatctggatctgataaaagaaatcgtggctgtgggaaaggaacaaaatcggctgaaaatgattttaaactgcaatacagcacaagaaatatatgatacattaatttttgatgaaaagagaaaaagatcttaagattccccggctgttacgccggggaaaaagttattcacaaacagggtcttctatcagagtggcaacgacaaattcatgtttgtgccctgcgtcagtagaggtgcatcctgcaacaaaatgcacatggcggccgcagcctacatcaatggccggaccggatgttccgcagaattcgtgatgatgtccatcacaggaatccgtggtaaatttgatttcatgaacatggcttccatcgcatggaatggcattgcttgataccgtagcaaatctgtgattatgcgcgtaatcacagcatcctgcaattttggtgctgcctaacacttcatggttatgctgttttggggtacaaggtttgctatttatattttggctcataattacttcctttcagttattgattatagttacaatcatataatatgcacaatcgacaaaaagggaatgaatatactggaaataaaaaaagaaaattccttctaaataatgaagtcaaagattaattctacggagtgctgattgtgttttcataagtctttttttcgattaattaccgaggtgaaatcacatggacaatcagaacttttgaggaataagcaaaaaactggtcaaatgccaaaaaaagaaaaacgcagaaaaaaactgtgttttctctttttttggcattttttttgaagtatctgcatttaaaacttgaaaaccaggaaataatatgatataatttacaaaataaagttaattgattaaatgaataataaggagaggcgccgatgatagacagagatttgacaaaccgggaaaaactgattatgaaatgtgtgtgggccgagaatcaggagatttccatccaggatcttcaggataaactgaaagaaatgtttgactgggatgcaaaaagatcaacggtccgtacgtttttaacaagcatcgaaggaaaaggattcgttaaaattgagagaagaggaagattttcttatctcaaacctttggtcgacgaaaaaaaatacaaaagagaacaggtacagaaaatgattgatttttggtacgggggttctaaagtagcactgataaaaactttaaatggaggtaaactgcccaaggagaaagaagagtatcttcgaaaagtatttaatgagccggaagaataaaaactgcaggaagattctttctgtacatcaatcagtattgtcatatgatgatttagactatgagccagatatttcaaagactggctctttttttcataggaaagttctacgaccttccctatgaaataaaaacgctccgcgggttgtacatagatgcgtaaggaaatcatttgcctttggcaaatcgcatctggcacgcaaagttgtcaagcccctcaaagattgaggggctggggagttgaagtaggcatgcccactttgttctgacaaaaagaactgctgtactttttccgcacagcagtcccggtttaaaacatgattatgtagctataatatctgagttattcaatgctcagcggttcgtcattagagatagaagtgccgtcttttgctttggccacataaaatacagacaaattttccggctgataatagatttccaatgatgacagggaatttaatttcacaccttttgatttaatgtcctccttcactgtcttttccacatctgcgacgagcacattgtgactctgaaactgtacctctgtatagattttcatatttatatccattcctttcgcttcgctcaggcacaaaacgttatgaaaatatttccctgagcttattttttctttataattcttctttgtagggaactcggtatactacaaatcacgaggaggtgagtgggctgtccggctctccggatgaccgtatttttatatgtgtagtccgccttttcaagcacaaataagtgtgacttcgagcacgtaatcttatctttgtataaacaatctcgtttatggcttaggcgttcagtcaatgccgtctctccctataatcttcagtgaaccttttggttctgaaaggagtccctatggctttaaaaatcgtgtacaaaatctgctgtggtattgatgtccacaaaaattttgtagtggcctgcatcgcctctaccgatggtaaaggcgtcaccacttatgagagccatcgtttttcaacctacacgagaggtctgaaaaatttgttacaatggcttctcaaacataactgcaaggatgtctgtatggaatccaccggtaaatattggatccctgtttacaacgttttagaaaacgactgtacgattgtccttgcccatcccaaatatgttaaggctatccgtggaaagaaaactgacaagaaagatgccaaatggattgctgacctgtttaagcatgaccttgttaccggaagctttatgccacccgctgacatccgtcagctccgcgaccttatgcgttaccgtttcaaactgacctgcttcaaatcaagcgaaaagaatcgtttgcagaactgtctcacggtttccaatatccagttgggaaacgttgtttcggacaccttcggcaaatctgctcaggcgatactggataaacttttggaaaatcccgcagatacttcttttgaccttgaacctctcgtttacaaaagtttgaaaaagaaacttcctgaactccgggatgccattgacggctatatcactccggaacaggctggtaaacttaaggtgatcaaagcgcattatgaaaacctggaatcccggaaagcagagcttgaagaactcattcttgcgctcgccgctccctatcagcaggaacttgccattctccaaaccgctcctggtatccgcagtgacttcactgccatcggaatcatttccgagattggtaccaacatggaggctttcccttcggcgaaacatctgtgctcatgggctggtcttgctccaaccaacaatgaaagtgcagggaagaaaaaatctgtccgggtttccaaggccggatgctatatcaaacctcttttagtacagtgtgctaacgctgtgattaaaagtaataagcatcctgagtttcgtaaccgttatctccgtatcaaaaagcgtcgcggtcacaagaaagcaatcattgccgtggcaagaatgcttcttactgcattatatcacatgctgaagaacggtgaaaactataattcggaactttaccgaaaatcagaagtgccccctgttgaccgtgaaatcacggtagaacaggccatcatcatagcaaggaatcaaggttataagatcaagtcagcaactgcataaccttaacttttcaatattcactttttaaagtagccaccggaagatggcttatttgttatgcgattaaataaatggataccctctacttctcattttcaatctttatcctcctttcatgctttaatttttttattataaaccttgtttcataaatattcaaaggatcaggtgaaaattccatcttttggtgccgaataagaaggtaattgagaaaagcccttattataagttatatggaagagatgataagacaggcaaaatataaatatattttataatttatgattgacattctggtaaaagagatatatgataaacacataacatatgaatgattgttcatatgaatgaatataataataaaaggagggtgagaagttgacagtacatgatatagactgctgtgatacctatcaggtccatgatgaccttctgaaagcagtaaatgaaaagatgcccgaggaaagtgaactgcaggatctggcagacctttttaaggtgtttggagattttacaaggatcaggattttgtttgttctgtttgaagcggaagtatgtgtgtgtgacctggcggaggctcttgatatgactcagtctgcaatttcacatcagctgaagatactgaagcaggcaaggctggtaaaatcgagaagagaaggaaaatcagttttttattcactggcagacggtcacgtaagaacgatcatcgctcagggaagagatcatattgaagaataatcataattaaaatgggaggatatcatgaagaaaaaatttaagttacaggatttagactgtgcacactgtgcggcaaagatggaagaggcaatcaaaaaaataccgggagtaaatgacgccagtgtaagttttatgactcagaaaatgacgatcagcgcagaagatgaaaagtttgatgaaatcatgcagaaggttgtcagtacctgtgccaaggttgagcctgactgcaggatactcatctagctgataaaacccggatggaacggagccgatcccgcactccgggttttgtttttcaatataaggagactatgtttatgacaaaaaaacataaaaagatgctgatccggatcattgcagcatttttcctgcttgcagggctgatgatcgcggaacatacgggcaacctccaaagtttggaaggttcatggactttgtttgtgatttatctgatcccgtatctggtgatcggctatgacattatttacaaagcagccagaaatattagaaatggacagatatttgatgaaaatttcctcatgatgatcgctacgttcggagcctttggagtgaaagagtattccgaagctgtggccgttatgctgttttatcaggtgggggaactgttccagagttatgcggtgggaaaatcccgccagtctatctcagagctgatggatatctgccccgaatatgcgaatatcgaggttgatggagcgctcacacaggttgatcctgatgaagttgaaataggaagtttcattgttgtaaaaccgggggaaagaattcctttggacggcgtggtaatcgagggggaatccttggtcgatacagccgcactgaccggcgagtccgttccgagaaaggcagctgcaggtgatgaagtgatcagcggatgcgtcaacggaagcggtacgctgaaagtagaagtgacgaaagaatttgaagactccactgttgcaaagattctggaactggtggaaaatgcaggcagcaagaaggcaaatgtagagaatttcattactaaatttgcaaaatattatactcctgtggtaacaatcggtgccgtgatccttgcggtattccctccactgatcttaggaggaggctggggtgaatgggttcagagagcctgcattttccttgtaatctcctgtccatgtgcgctggtaatttcagtgcctatgggatttttcggagggattggtgctgcctcaaggatcggtgtactggtcaagggaagcaattatctggaagctgtatctgagatgacgaccatagtatttgacaagactggaactctgacaaaaggtgaatttaaagtgactgagatcctgccgcagggacgcagagaagaggaacttcttgagcttgcggcattgggtgaagggtattcgaatcacccgattgccggttctattaaagaagcatacggaaaaacagcggatatgaaccgtgtgtccgaggctgaagaaatcgcaggacacggaatccgtgtcctgattgatgggaaagaagttctgatcggaaacggcaagttaatgagacagcagcacattgactatgtttcctgcaacagtaccgggactgtcgtctacgtggcctctgagggtgtgtttgcaggcgctatcgtcatttctgatacggtaaaagacggggcaaaagaggcaatcaaaagcatgaagcaggtaggcgttaaaaaatgtgttatgctcaccggagacaggaaagaggcagctgaatctgttgccgtacaattaggaattgatgaagtatacgcagaactcctgccgggcgacaaagtatcccaggtggaaaagcttctgaaaaatcagagagagaaagaaaagcttgcttttgccggagacggtattaatgatgcaccggtgcttacaagagcagatattgggattgccatgggaagcatgggatctgatgcggccatagaagctgccgatgtggtattgatggacgacgatgtcagaaagattgcctccatcgttcatatttcaagaaaaacactgcggatagtgaaacagaatattgtgtttgccttaggtgtaaaggctcttgtattggctctaggcgcagccggaatggcaaatatgtgggaagcagtctttgcggatgtgggagtatcggtgattgcaatcctcaactctatgcgtgcgctgaaaagcggtgaccaagaataaaagaaaattgagagaaaaggcctgattcagccgaatatggtataatgcagcaaaacagaaaaatcattctgctttgctgcattttccttttttacctctcaggaaagagactccgtgacttctttgaactgaaaaacactacgggaacaaagaaaagccttataaatactgcatttaaatgaatgagcaagaggaaatattgaaggatttacgacaatagtacaacaaatgaaagaacattgtataacgacttctattgctatgtttgatgaatgctgaaatattatagacaggtgcttaaaaatagtgtaaaattaacttgtattaggaaaagaaaaatactttttaattttgtataaaaaggggttgacagacatgcttagaaactggtatactatgacagacagacagacagacagacagacagacagacagacagacagacagacagacagacagacagacagacagacagacagacagacagacagacagacagacaggtaaagtctgccttttttgcgtacaacctatatagacataccaaaagcacagatacactaattatatggtgatctgtgtcttttttgcgttctgtagaaaaatgagtgaaaagagggaagaaatatgtataaagagagtgtcaagaagaattttcgttacataatgtcaaaatttgtgtgtgtggtttttgtagtaattttaatattaaattgtatgtctttgcaaattaaagcagaaggaaatacgaatgggaatataacagatagtgaatataatccaaaatatactattcaacattatttaaattacccagcgatggttttagatattccaaattctggagataagacaggaatggatttagtaaatgcgcaagcatctaagacagatacgatgattgtatggcgaacagatgcttcacgggaaaataatttaccacgtaattttaagaaacaaaatagttatggagagaaccatggcgtggatgaattatatgaacaaagtccacattcgcaactaaacttaaatgatgatggaacagtaaaaacagaaaatgaattacgaaaattgtttgctgatgaggaaacatatttctttgaaaaatcacaaatgcgattcatgaataagctttataatgataaaagtgaaaatcattataataagaattatacattagaacaggtttggcttttgaaagaaggtaaggataaagatagtactaatgaagaggatttttatgtcttagatgcacctgtaatggatgatggaatccatcatgatccttctaagtttactttcactaactataaggacaatccagcatttaattccacaaaaactacaaatgctgatggtgtgaaatatattggagattcaaaagacggttatacgattttaattactgaagatacggtcattcgtctagtttttgaaccaactacagaagaaaattataattatgatgcagtgaattttttcgattatgatataacggatggatggatttatactacagaagctgcagctaatgcagcaagagatggtcaagaggtagataatataagcaaaaaggttgataaggcaatagaagcacaaactttagatcaattagtttcaaacagtaaatttaatgtagatggtaaacttccaacttcttatcaaagcaaagatgaattgaaaaatgtaacattttatgcaaacacagcaaaacaaggtataaataaccgaaataatcttcctgctggagcagagcaaaaatttgcttttggaaacgataatgctgggactggattaggaaagaatacttggaatgattctaacggtgtagcggcatcattaaatatgactaatgcaggaaatcgtgctggaaccagtaaatggggtactacattctatggtccgagtcttcgaggggcaacatttagtttgggtcaaggcgtcaatgaaaatggaagtattaagtggagtgagggggtaaatgcacctccaatcttttcaacagctaaagatactttgaattcagatggtatagataatccaaatggaatacaagggaaaacggaatatttaaaatatagtggatatgggacagaaaattccaaagaaaactatagcttacagttttctcgtcttggaggtacatatactttatctggagttaagaacaataaagggaaacaagtcagcagtaagttggataaaatttctaaaaataaatcatctctttattcaaatgaattttggccgatggattatgcttcatcatatggaactgatggacacgatcttaaatttggaaatttaaattccaaagatcttagaaattttgtaggaattgatggttctggagctaaagtatctggagcccttccaacaagtgatgatcaaaataatgatcataattcttactttggtatgacaacatattttgattttgtgttacaacctggatattgtggaccgttgaattacttcttttatggagatgatgatttattagtgttcttgtcagaaacaactgtttctgaggatgggacagttacagttgatcatactaacagtgtacaagtggcagacatgggtggagttcattcgtcattaggtatgtacgtagatttatgggaatttattgatggagcagaagatataaaaaatagtgatggagagacaattgccacaggtattccatataaagataataagaaaacatatcgtttatctgtatattacacagaaagaggagcatctggatcttcatgctatatgagatttacagttccatttgaagagttagcaacaaatccaattacttttaatcaggcaattcaaattgagaaaaatgttaagagcaattcaaaagaagataaaggtgtatatgcatttcagttggatttaacgacacctgacggaaattctatggttaatcaatatccatataagagatatgatgcaaatggaaaagaaattagtacttctaatgcttcaattgtcagtggaacaaaattttttttaaaggatggagagaaagtgctgatttctcatttgccaaaagatactgataaggatttggagaaaggctatggatataatgtaagagaattaggaagagtagattcatctagtacaggataccctgataacttgaatccaagtaatgttacagttattccattgactccaaaagattcaacaacctttatgacaggaacaattaaggatggattaggtcaaaaattaacattgggtgttgattatggggatgaatttgataaaaacaattatgttcgttttattaatgccacagaccctggaatgttagaattagaaaagcaattatctgttgatacgcaatcaacagataaggatttcaatttcaacgtatatttcacaaaagcagatgggacgcctttgaactctttatcatggtttaaaagcccgactgatgttgagagtccaaactgggttgaacaatcagatattgagttgcaagatggtaaaggcgtgttatcaattaaagctggtgaaaaggttttgatttataatttaccaaaaggggcaacctataccattacagaagccaaaaacacatattatggggtcaaagagattgttactacaggaagtggaaagataaataaagacgaagcttctggaaaggttaccggaactattatagtggatgagaatgtgaccgagatggatcaaaaaaagccatctaataccattaaatatgtcaatgcaaaaacagaaacaggtggcttgacagtaacaaaacaagttgcgggaacacacggcgataaagacaaggagttccatttcacggttacgcttgatgataagacaatcagcggaaaatttggagatatggacttcgcggacggcgtggctacattcacattgaaacacgggcagagagcaacagctgtgagacttcctgctggtatcagatatacagtagaagaaacagaagccaaccaggacggctatgtgactacttctactgctgacaaaggaacagttccagaggatggtaatgtgggaatcaagtttatcaaccacaaggaagtgacatcagagaagccatccacacctgataaacctgatacgccagacagtccaaaaacgggtgacagaacaaatatagtgttatatatatcattgttcgcaataagcggactattaatcgcaattctaatcgtattgaagaaaaagaaaatattggagaaccgaaaaagatcttgaaataagattgtaacggctacacaactcacattgacggagtgatccagacacggtggcggggaaatctcaggatttttccgccatgcttgcaagtggctggttcacttcgtctgtgagcgagcctgtggcgagctttatgtagcccccgttatctaacaagggggcacaggaacgctcatggtatgacttcatgctcgattgtatgacggctggcggtgtgataaaacgggttgacttggacacagagattaaaaaccgttttgaaatacgcatgaagaatgcacgagcctattatgctgttgtggacttactcattttgtattcaaatgcttagtttgtatcaagtgttgatgcaagaaagaagaaatatattttatcaggtagatgataatggtgtcatctttcaggccgatggagaaagctcaaaggatatattatggaagaggcgaatggcatgttcgtccaatgaacaattctcgattgataaatccatgacattggacttgaacggatacagtattggctccataaaagagcagtcttttgtgataaataaatatggggaaacgactgaagtcaagcagaaaaacggaacgatcaccaatgacagcagcgaatcagacaagttaagcataccggtgtttgcaagacaaagagtcaaactgcacctggagaatatgaagcttatattgaatccaaacgccggcatgatgggatatggcctgaggattggaaatggagatcataatcaggcaccgtaaaagctttcaatatcggcggagccgcagtttatcatcctcagaacggcaatctgacaatcaacggcggcattgcggagaatacggaggtgctcagggagccgaggcatccattgtatttaaagtcaatgggggcagctctgtggataatctcacaggattgacagaccaggtgatttctgacctcactatgccgaaaccgaagaccggcagttcagcgcaatcgaagcgggtcacccaaaatgcggctaaagctggggagcctttggaatttgcagcttgggcaggagtcatgctcacggctctggtatgcggtctggctgcggcaaactgtaaaaagaatgcaaagcataaataacattccatataccttatcgtgcgaagcacgtccacccgaagggtattaaatacggtgtgccctgcgggtatacttttctgagcttatccgggtgtttggcagagaaatgccggataagctttgtttttagttgcgctttttctgtaaaacgtgctaaaattctttcagatataaaaaggagctagttatggaactttcgatgataggaatagattatcatacggcatcggtggaggagagggagccgtttgcatttacagattcgggagccacccgattcatgaagtctgtgaaggaaacggacccaaatgcgtcctgtatcgttctgtcgacctgcaaccggacagaactttggttttataatctgacacctgaccctctggattaccttttttcacagctgtctcttttaaaggattcggggagagaactgttcgtcagaagggccggggccgaggccgtcttttatctgatggaactggccagcgggctccactctcagatccttggggaagaccagattgtgtcccaggtcagagaggcccttaaccgtgccagagaatgctgtaagccggaccctgttctggacacgctgtttcggatggctgtgacggcggcaaaaaaagtcaaaacggaaacccggatcggaagcagggacacctccgtgccggaacgggctgtttcgattttggaagacaaatacggctcatttaaaggaaaacaatgtctggttatcggaaacggagaaatgggccgtcttctggccgcatggctggtacataaaggggcctgtgtttccatgactctgcggcagtatcggaaacaggacgtcatgatcccggcaggatgcggtgttgtctcttaccaggaccgttacagcgccatgggagctatggagtttattttcagtgccaccagaagcccgcactatacgatacgcgcacagcaggcggcagagacttttaaagagcaccgctcttatgtgtttacagatctggcagtgcccagggatctggacccgggtcttgcagagctgcccggatgctgccttttagatatggacgatctgggccttcaggtatcggcagatgacggggagcttaagaaggcagaagaaattatttgtgagcagtccgatgaatttatgaactggtattatttcagggattatattccgctggtccgggcggtcggcagtgctgccggggagctgaccaatgccaagctgaagaaaacatacagggaactcagaaaaaaacaccaggatgtatgcggccttaaaaaagaggtgatgagggcatcagaatcagcggttgaacggattctcttcggccttaaggatgtgctcccgaggcaggagtggaaacatatttttgaggcgctggaactgtcggcagatgaggtggatattttttaaggaggcttgaccatgggatattttccgatgtacacagatatccgggatttcaagattttgatggtcggaggaggagcaatcgccctgcggcggcttaagacactccaaatgtttcatgaacatatcacagtcatatcactgtctgtctgcaaagggatagaagatatggtccttgacggctttgtcacctggatttcaaggagttatgttccgggagacctgaaagattttgatatggtgcttgccgcaacagataacagggaagtcaatcacgctgtttttctggaagcccggagggagaaaatgcccgtcaatatcagcgactgcaaagaagagtgcagtttttattttccttctgttataaaggacggcgatattgtcatcggggtcacatccggaggcaccgaccataaaaagacaaaacagacagcagacagaatcaggagtttgatatggaaccaaaaagactgaggatcggaagccgcgaaagccttctggctgtggctcagacaaaacttgtaatagagcagttaaaagcaaattatccggatctttcttttgagctggtgactctgaaaactaccggggataagattcttgataagacgttagataagatcggaggaaagggactctttgtgaaagagcttgatcaggctcttctggacggaaggatcgatatggcggtccacagcatgaaggatctgcctatggagatctccgatgaccttcccgtggcggcagtgcccaaacggggtgatccaagagacgtgattgtgctgcctttgaccggagattttggggaacccggacaggtgatcggttcttccagtgcgagaagagttctgcaggccagaggcctgtttccggaagcagaatttcaaagtatccgagggaatatccatacgaggcttcgtaagttggacggcggacagtattctgcattgatcatggcggccgcgggactaaaaagggcaggccttgaagagcggatcagccgttatttttctgtggaagaaatgctgccggcggccggacaggggacactgtgcgttcaggtgagaaaagattttgaccagtcctttttttcatgtatccatgacagggggacggaacttgtgaccgaggcggaacggagttttgtacgtgctttggacgggggctgttcttctccgatcgcggcatatgcagagattacaggaagcgaccttaaccttaccgggttttactgcgatgaatcagacggcaccggaagggaaaagagcattcggggaaaagcacaaagtgccggtgagcttggccggcgccttgcagaacagatacgagaataaatgatacagaaagaaggatgcagaatggatatgacaataagatcaagaaggctacggtctacaccggtattgagaaagatggtgcgggagacgaggatggatgcgtcttctctcatttatccgctttttgtgcgggagggagaaaatgtgaaggaagaaatcccgtccatgccgggacagttcaggtacagtctggaccgcatgccggaagctctgaacgaaatggcagatgccggggtgccgagtgttatgctgtttggaattccggatgcaaaggatgagtgcggcaccggggcgtgggcagaggacggcatcatccagaaggcattgagaaaggcaaagaaggaagtgccggatctttattacattacagacgtgtgcatgtgtgagtatacctcccacggacactgcggcattttgagcggacaccgggtggacaatgataagactctgcccatgatcgctaagatagccctgtcccagatacaggccggggccgatatggtagccccgtctgatatgatggacggccgggtctctgagatcagaagtctgctggatcagcacggttacacagatgtgccgatcatgtcctatgcggccaaatatgcttccgctttttacggcccgtttcgggatgccgcaggatctgccccttccttcggagaccggaagggatatcagatggattatcataatcgcctggaggccctgaaggaagtgaaacaggactgtgaagaaggagcggacatcatcatggtgaaaccggctctctcttatctggatattgtgagagaagtgcgcagtacggtagatcttccagtagctgcatacagcgtcagcggggagtatgccatgatcaaggcggcagccatgaagggctggatcgatgaggatcagatgatctgtgagacggcagccgggatttaccgggcaggctgtgatatactcctgacgtactttgctaaggagattgccggatttatgagggaagggaggatcggatgatgaccagatcagaagatttatttaaccgtgccaaacgggtgctgccaggaggcgtcaacagcccggtgagggcttaccagtctgtgggaggctgtccgcggttcattaaaaaagcggaaggtacttatgtatatgacgaagagggaaaacgctatctggattatatcggctcctggggaccgatgatcctcggacataaccattcggagatccaaaaagcggtcgtggaagccgcacaaaatgggctgagctttggtacggctacagagatcgaagtggagatgggagaactgctgtgcaatctggtgccgtgttttgatatggtccgcatggtcaattcgggcacggaggccgtgatgagttcgatccgggctgcgagaggatttacgggcagagataagatcatcaagtttgagggatgttatcatggacattttgacgcactgctcgtaaaagcggggtccggtgtgatgacggcaggaatcccggacagctccggtgtgccaaagggctgtgcgaaggataccctgactgcggtgtataacgatataaacagcgttaggaaactatttgaagaaaatccgggacagatcgccgcgctgatcattgaaccggcagcggcaaatatgggggttgtattgccgaaagaaggctttttgcaggaactcagagatatctgtaccaagaacgggacactgctgatctttgatgaggtcattaccggcttcaggctgggacttgcaggtgcacagggaacttacggcgtgacgccggacctggccaccttcggaaagatcatcggaggaggcatgccggtaggctgctacggaggacggcgtgagatcatggaaatgatcgcacctctcggcagcatttatcaggccgggactctgagcggaaatccggttgccatggcggccggcatcacggaacttacgattctgaaagaacacccggaaatctaccggcatcttgagaaactcggagagtctttcagaagcggtgtaaaagagatcctaaggcggcacggaaaggaatatcagattacagggacagggtctttaagctgtctgttttttacggaccgtccggttgccaattatgaggacgcaaagacttccgatgtacaggcatttgcagagtattttcattatatgctggatcacggaatccatctggccccctctcagtttgaagctattttctttaacaatgctatgaaacaggaggatgtagatctgacactggaagtgatggattcctttttttcatttcacaggaaagtcctatgaccttccctatgaaataaaaacgttccgcgggttgtgcacagatgcgtaaggaaattatttgccttcggcaaatcgcatctggcacgcaaagttatcaagcccctcaaagagtaagggattggggcgttgaagtgggcttgcccacattgtgctagagaagacaaccgggaggaattctatgagcaggggacttaaagagcataaggtcataaaacagaataaagaactgagatgcggttttacgacaggctcctgtgcggccgccgctgccaaaggagccgctgcagccctgcttttgggaacacaggaatcaaatgtttctcttctgacacctgcgggtatccgtctttttctgcccctggaggatttcagggtatcagataattcggtttcctgctgtgttaccaaagatgccggggacgatccggatgtcacagacggtattcatatttatgcggaggtgaaaaaaatcccttctcccggaattttcatcgaaggaggagaggggatcggcagaattacaagaaaaggccttttcctgccagtcggcgaggcggccatcaaccctgtgccgagagagatgatcacagatgccgtgcgggaagtccttgaccgttccgattatgaaggcggcctctcagtaaccgtccggacgccggagggcggggagacggcaaagaaaaccttcaatccgcgcctcgggatcgaaggcggcatttcaattctcgggaccaccgggatcgtagaacctatgagcgaagcggcgatggtcaaaagtattgaggcagagatgcggattcttctcgcagagggaaacggatatcttttagtgacgcccggcaattacggggctgactatgtaaaaacacactgcggcatttcgggagacaatatactaaagtgcagtaactttgtgggtgatacgatagacatggctgtcaatttaaaagccaggggaattctgtttgtgtcccatatcggaaagtttatcaagcttgcaggcgggatcatgaatacccactcgagagaggcagactgccgggcagagcttatggcagccgctgcagtaagaaacggggccggccttaaaacggtcaaaaagatccttcaaataaagacgacggaggaaggcatttcttttctggaatcagaagggattctggaacggacgatggaagacgtattagaaaggatcggggaaaatctttcccgaagggcctatgacaggctgttgaccggtgccgtggtcttttctggcgggcacggatttctggggcagacgaaacacaccgatttattatggcagaaactaaaggagacagaatgagcggaacactatatggaattggagtaggcccgggagatccggaacttatgactttaaaggcagtgagaaagatcagggagtgcagggcagtcgctgttccgggcagaaatccggaagaaagcacagcttttcagatcgcggcaaaggcgtgtccggaaataaaagataaaaaactgatcggaatccacatgcctatgacgagagatgaagaaaaactgagggagagccatgaatcgggggctttttttctgacagaatgtcttaagaaagggatggatgtcgcattcttaacgctcggtgaccccacagtgtattccacttacctgtatttacataagatcgtcagaaaacagggatttccggcagagatcataagcggtattccttccttttgtgcggccgctgccaggatggaaacagggcttgcagagaaagatcaggcactgcacattataccggctgcatatgaggtggaagactggctggaactttcggggacaaaagtattcatgaaggccggaaaacaactggctcaggtgaaggagaaattgtccgaaaaaaaactggccggaagaatggtagaaaactgcggaatgaaaaatgaaagactttatgacagcattgaagagatcccccaggaggcagggtattactctctgattatcgtaaaggaacaggaggatgtacaatgatttattttgtcggagcaggcagcggagcgccggacttgatcaccgttcggggaaagcagctgatcgagacagcggatatcctgatctatgccggatctctggtcaatccggagcttcttttatatgccggacctgactgtaagctctataacagcgcagaaatgacactggaagaagttttcaaggtcatggaagaaggggaactggcgggagaggacacagtccggctgcacactggagatccatgtctttacggcgccatcagggaacagatggaccttctggatgaaaaagaactcccttatgattactgtcctggtgtcagttctttctgcggagcggcatctgccctgaacttagaatatacacttcccgatgtgtcacaaagcgtcatcatcacaaggatggcgggaaggactccggtcccggaaaaagaaaacatcgaatcctttgctgcccatcaggccaccatggtgattttcctcagtacaggaatgataaaagaattatcagagaagcttgtgaaaggcggatacacccgggagacaccggcggccatcgtctataaggcgacctgggaggatgagcagacctttctctgcactgtggggactctctgccagacggtaagggagcacgggatcacgaaaacagcgctgatcattgtgggagatgcggtctcccatcaccattataagaggtctaagctctatgatccggagtttactacgggatacagaaaaggaatcgaaaaatgaagacagccatcatttgctttagccaaagaggattgaatattgccgggaaattgaagacgggtctcaaaaagtcaggtcacgaggcagagatctcagtgaaatccagatatattaagaaccgggatgtacactgtgtgacagaatcattaaatgactggaccgcaagacagtttcaggaaaaagaagccttatttttcatcggggcctgtgggatcgcagtgagggccattgcaccttttgtcaaaagcaaagacactgatcccgcagtcatagcggtcgatgaggcagcgagctttgcggttcctctgctgtccggacatctgggaggcgccaacgatctggcagaacaggcggctttcctcacgggggctgttcctgtgattactacggctacggatataaatcaggtgtttgcggtggatctgtttgcaaaaaagcaccgtctgcatatcatggatcttgggcttgccaaagaaatatcagcctctctgctgtcagggactccggtcgggtttcacagtgactttccggtgtctgggaatctgccggagggactggtacggggagaagacacaaaactcggcatctgcatttctgtgaggaaggattttcttccttttcagaaaaccctgaggctgattccgaaagcagtcgtttttggagtgggatgcagaaaagacacgccggaagaagccataaaacaggcttttttacaggcctgtgaaaaaggccggattgagcctttggcattgggattgacagccagcattgatttaaaaaaggaagaacgcgggctccttgttttctgccgggagaaaggaattccttttcaaagtttcactgccgaagagctgatgcaggcagaaggagcatttatgtcctctgcctttgtcagccgtgtgaccggcgcagataatgtatgtgagagaagcgcccttctggcggccggagacggaggagaactgatcgtgggcagacaggcaggaaacggcgtgaccgcagctcttgcgttaaaagattggaggatcaggtttgagtcataaaatatatgtagtgggcatcggcccgggagcgtttgaacagatgaccgcaaaggcggcagatattttaagacagagcgatgtcatcatcggatacaccgtatacattgatcttgtaagagatcacctgccgggaaaacaatttttatctacccccatgacaaaagaggcagaccggtgccggatggcatttttggaggcgcggaagggaaagaccgtgtcgatgatctgcagcggggatgcgggaatctacgggatggctggtctgatgtatgaaatcggcgcacaatatcctgatacagaactggaagtcataccgggggtcacggcggccacagccggagcagcgctgcttggggctccattgacccatgatttctgtgtcatcagcctgagtgatctgctgacttcatggaaaaccatcgaggaacggattcttgcggcttccagggcagacttttctatctgtctgtacaatccgtccagcaaaaagcggcgggattatctgaaaaaggcctgtgaactcatgctcaagtataaatccccggacacggtatgcggaatcgtaaaaaatattggaagagagggggaggaaaagtttctcctgactcttaaggaccttaaagatgcagaggccgatatgtttaccacagtatttgttgggaattcccagacaaagaccctgtccgaagcgatggtcactccgagaggatataaagatgtataaagtatttttatttgcgggcaccacagagggccgggaactggcggggtttctaagccgggccggtgtggaggtctttgtatttactgcaactgaatatggaaaaagcctgatcggggaagcggagaatatggtcctgtcctatgaaaggctttccgcagaaaagatggaagaacagatcagaaccgaaaaaccggatcttgtggtagacgccacacacccgtatgcagaattggtgacggagaatatacggtcagcctgtatccatacccatacggagctgatacggctggtcagggacgaggggacatgggacggaggagacattacatatgtcagttccgcaaaagaagcagcggagtttctttcacgtacagagggaaatgttcttttgacaaccggaagcaaagatctggcagagtttaccgcggttcctggttatgaagagaggatttatgcgagagtcctctccctgccggacgtggcaaaaagctgtgccggactcgggtttcggggaagccgcctgatctgcatgcaggggccgttttcaaaggaactgaatactgcaatgctcaggcagtatgactgtaaatggatggtgacaaaggcctccggaatggaaggcggatttccggaaaaattagaggccgccagagaggcgggggcaaagcttctgattattgggaggccgaaaaaggaagaggggcttaacttcaaagaatgccggaagatgcttagggagcgttttcagataccataccgtccggagattactcttgcaggcgtgggaatgggaagtatcgaaatgatgaccggggaggcagtgcgtgcatgccaaaatgcagatcttctgatcggagccggccgggtgctggaggcagcagaaaaagcggccggaaacgctcataaggcagagctttataaggaatacaaaagtgaggaaatcttttccttcataaagtctcatccattttattaccatattgtcattgctatgtcaggagatcccgggttttacagcggggcaaaaaaactgtacggactgctgtcttcagaaaaagaatggaatgtaaaagcggtgtccggtatttcttctctgtcctatttcatggcgaaactgcatctttcctgggaagatgcagtgatggtaagctgccatggacagaaaacacatcttgtacagaaaatagcgtccagcaggaaggtatttgcgatcctgggcacaggaacagaagtcggggagctggcaaaggaactccttcaatatggccttgacgacgttatcttccatacgggggaacggctttcttaccccgacgaaaagatcagatccggtctgccgcaggaattcctttgctgccggacggatgctttaagtgtgctctgtgtggaaaatcccaggccacggaaacgttttgcacttcacagtttacaggatgatctgttcgtgcgcgggaaggttcccatgacgaagcaggaagtgaggagcatcactctttcaaagcttaagcttttaaaagatgctgtctgctatgatatcggtgcaggcacaggatctgtctccatagagatggcagagaaagcatatgaaggacgcgtatatgcggtggaaaagaaactggaagcggcagatttgatccgtcaaaaccggagaaaattttgtatggattctattcatatcgtggaaggaacggcaccggaggcaataaaaaggctggaacccccaacccatgtctttattggaggaacctcaggcaatcttacagaaatccttcattctgtattaaagaaaaatcccagggtcaggatcgttatgaactgcattactctggagacacttacagaggcagtcaaggcctttcaaactctgcctgttacggagccggatatcgtgaatgtgacggtgagcagggcgaaaaaagccggcagctatcatttgatgatgggagaaaatcctgtttatatccttgcctgctccggaaccggggaggcgtgccgtgaagattgacagactcttatttacggccccgcagagtgcaggcgggaagacgatggtgacctgcggcattcttgccgccctcggcgggatgggcagaaagacggtgtcctttaagtgcggaccggattatattgatccgatgtttcaccgcaaagcagtcggaaccgatgcctggaatttagacccctttctgacacccggcccggcagtcagatccctgctggtccgccatgcaaaaaacgccgatctggctgtgatggaaggggtcatggggtattatgacggcctcggagggacaacgacaaaagccagtgcatatgaactgtgtaaaatcacaggcactcccgcagtcctgatcgtcgatgcaaaaggggtgagcacctctgttctggctcagatccatggctttttatcatggaaaaaggacagcgggatcaggggagtccttttaaaccggatatctccgatgctctatccccggatgaagcagttgattgaggaacagctggacatcccggttgtgggatatgtgccggaagtcccggactgtgtgtttaaaagtcgccatctcgggcttattttgccggaggagattacggatatcaaagataagcttcaccgtcttgcaggcattatgagagaaaccattgactgggatacattattcaggattgcggaaggtgccgcttctctggaggcagatgatgaaacagatcctccggattattttgagaacacagacctttctaaggtaaggattggaattgcggaagatgaggccttttgttttatgtacagagaaaatttagaactgctcagtgacatgggagcaaaacttgtgtttttttcgcccattcatgacagacacctgccgaaagatttggacggactgatcttttacggcggttatccggagctttatggaatggaacttgaggaaaatcatgcgatgagacgagagactgcatctgctgtgtcctccggccttccatgtatggccgagtgcggaggctttctgtatcttcacagggagatggaggataaagacggcgttttcaggaaaatggcaggcgtgattccggggaaggcatataaaaaggacagactttcgaggttcggatatatttctttacatcagagatcgggaaccttgtttggaaccggtccggcaaaacttacagcccacgaatttcactactatgattccgactgctgcgggcaggatttctatgcaaaaaaacctgtgggcagcagaggctgggaatgtatattcgcatccgacactttgtttgcaggctttcctcatttttattactatggcattccggaacttccaaaggcatttttaataaaatgccgtcaatacaaggcgaaaaagaggagataaaatggacatcacagaaatcagcagtcatatcaagaaaccggatgaaaacgctgtgaaacggtgcagggagcgctgggacagcatagcaaaaccgctgcacagccttggaaagctggaagatctgatcgtaaagatcgcgggaatcaccggaagtgagcacataaatctcacaaaaaaagcactggtttgtatgtgtgccgacaacggagtcgtggaagagggaatctcccagtcaggacaggaagtcacggcgatcgtttccgaaaatatgttaaacggcagggccacttccagtgtaatgtgcaggcatctgggtgcagatttgtttgccttggacgtgggagtcgcatgcgagacgtctctgatccaaaagaaatcagcttttggaacaaaaaatatgctgaaagagcctgcgatgaccagagaggaagccgtcagggccgtcaatgctggaatttccatggcatttgagctttcccggcagggttattgtatcgcggccaccggagagatgggtatcggaaatacggccaccagcagtgcggtcgcatccgttcttctgaaccggccggcagaagaaatgaccggacggggagcgggtctcgatcatcagagactccggcgcaagattcaggtgatcgaacaggcagtaaatatgcaccgtcccgacagtaaggacccgctggatgttctctccaaagtcggtggctttgatctggctgctctgacaggattctttctgggcggggcagcggcaaaacttcctatagtggttgacggttttatctccgggacagcggctctggcggcagcgaaaatctgtccagatgcagtccattccatgcttccttcccacaagtcaaaggagccggcggcaggactgctgctggacgcgctcgggctggatgcctgcctggactgcggcatgagtcttggagaaggaacaggagctcttatgctgtttcctttgctggacatgacattggatatctatgaaaaaatgagcacctttgatgaaatcaacgtggaacagtatgttcctctcggctgaaaggagggccggatgtttacattagtcaccggcggcagcggcagcggaaaatcagaatatgcagagagtcttgcagattcctggaacgatccgaaaatctatgtggcaaccatgatgccgtttgatgaggagaccggaaagaaaattcaaagacaccgggctatgaggagggacaaaggatttgtcactgtggaatgttttaccgggctttctgccctccatctcccggaggggtgtcatgtactgctggactgtatgtcaaatctcacggccaatgaaatgtatacagaagagggggctgggcttgacacaagggattccattctctccggcatagaaaatcttctggcatttgcagaggatgtatgtattgtcaccaatgagattttttcagacggaatagaatacggcgccgaaacgatccgctatcagagatgtcttggggctttgaactgccggatggctgagctggcagaccgggtggtggaagtggtatgcgggattccactgcgacagaaaggatgaggcaaagaaatgaaccagctttggaacagttttaaaatcgcattttccatgtattccagaattcccgtgccgggaagtgaatggacaaaagaacatatgaaatataccctttgtttctttccggcagtcggggttattgtgggacttcttgtcatttgctggtccgatttcagccgctttcttgattttgggatgccggcccgcacggcgggattaactctgatcccggtcattgtcaccggaggcatccatatggacggattcatggatactgcagacgctctgggatctttccggggcagagaaaaaaagctgcttattttaaaagacccccactgcggagcatttgccgttctttcatgtgtgtgctattttctggcatatggaggtgccgtcagcgagatcgggagaggaaatcttctgatccttgcctggggatttgtgctgtcgcgggcgttgagtgcattttctatcgcctcttttcccatggcaaaagaaacagggcttgcggcatccttctccggggctgcccataaaaaagcggtgcgcggagtctcggctgtgacggcggcaggttctgcggccgtcatgtgcttcctgaatcctgccgccggacttttgtgcatcggaggagccgttttatccttcgtctggtattaccggatctcgatgaagcagtttgggggcatcacaggggatctcgcagggtggtttctgcagatatgtgagctgtctgcggccatatgcctggccgtaatagagaaaataatgtaaaggagcagtcatgattatcatcataggaggagcatttcagggaaaaaaagaatatgcggaaagggtcaccggcatttcgggagaccagatgacagacggagtggagtgttctttggaggagatttattcctgccaatgcctttatcattttcatgaatgggtcaggcggaaactgccggacataaaggattatgaacaggaagccaggaaaattttcgaagcaaatccagagctggttctcatagccaatgaactcggctgcggtgttgtgccggtaaatgcattcgaccggaactttcgggagacagaggggagacttattacctgtcttgccgggatgagcagtgaagtgcaccgggtcgtgtgcggaataggtacggtgatcaagggatgatcagaggatatttgatccggcacagcatgacagggagcaatgctttgggccgctatgccgggaaaagaacagatgaagctttaagtacagaagggataagcctgtgtctggacaggatatatccgcagacagacgtggtctatacaagccctatgaggcggtgtatacagactgccggacttctttactgcggaaaaaagtctgtgatccgggaacagttcactgagtgtgatttcggcatttttgagggaaagaactacaaagagttatccggcgagcctgagtatcaggaatggatcgccagtaatggaaccctcccatttcctgaaggcgagagcagagaagagtttcaggtcaggtgtcttgaagggttttgtctatgcatagagcactgcatacagtatcaatataaaagttttgcaatggtagtccatggaggcacgatcatgagtattttagacggctttgccatccctcacagagattattttcactggcaggtgaaaaatctggagggatatgaaatagagacagatgaaaaacagtgggcctcagggaggcgtgaaatctatgtaagaagagagggaacagacatatggaaataagagcagcggcgttattgtttgggttttttctggacttcctgtttggtgatccccgctggctctatcatcccatccgcctgatcggttcagccatttctgcggtggaaaagggaatccgggctgtttttcctaaaacaccccgcggggaaagagcaggagggattcttctgatccttctgatcgggtccggttccttcgccctcccgttttttgtcttgaaaatgctgtacggctggagccagacggcaggatttctcctggagtcttttttatgttatcagctgacggcggccagaggtttgaaagatgagagtatgaaagtttacagagagcttactgaaggctctcttgcgggggccagaaaggcagtctctatgatcgtcggaagagatacaaaagaacttacccaaaccggcgttataaaggctgccgtggaaacagtggcagaaaatacatcggacggagtcgtagccccgttattttatatgtcgttaggcggtgtcccactgatgtttctctacaaggccatcaacacgatggattccatggtaggctataagaatgaaaaatatctgaatttcggcagatatccggcaaagctggatgacttggcaaactatattcctgccaggctgtctgcatggttcatgatcgctgcctgtatttttactggaaatgatgtattggcggccagacaaatttacaggcgagaccggagaaatcataagagtcccaatgccgcccatacggaagcagtgacagcaggggctctgcacatccggctggcaggaaatgcctggtacttcggagaactatatgaaaaacctacaattggtgatgatttaaggcctcctgagccggaggatataaaaagagccaacggcctcatgtatggatgcagcctcttggcagccgccgtttttgggtttatacttatgtgcatcggatggaagttttgaccggaaggaggattggcatgaagaaacatatacacgggggagatatttaccgtcacgggcatgtgactgatttctctgccaatgtaaatcctctcggaacgccggagagtgtcagagaagctgttcggaattcggccgacggcgtcgaatactacccggacgttcactgcagcaaattaaaaaaggcattatcagactgggaacaggttcctgaatcctggctgatctgcggcaacggcgccgcggatcttatttttgccctgacactggcgttaaagcctaaaagggcgttaatcctggccccgaccttcgcagaatatgaacaggcactgaaaagcgtaggctgtcagataacctatttttatttgacggagcaggaggaatttcttgtgacagagaagatcctttcagagatcaccccggctctggatatggtgtttttgtgcaatccgaacaatcccacgggagagctgaccgacagggaattactgttgaaactctcagaagagtgcagaaaaaatcaggtttttttagcagtggacgagtgtttcttagatttcgtcccggatggacaggactatgagctggcaggctgcctgaaacataaccgcaatatttttttgctgaaggcatttacaaagcgttacgccatggccggtctccgtctcggatacggtatctgttctgatgaaaatgttcttttcagaatggaggaagtgactcagccatggagagtgtcatcgcctgcccaggccgcaggaactgcggctttgtcggagcagtcctatttaaagcggtcagtacggttcgtagctgcacagaaacatatattaaaaaaagcattggaggaagcaggctttcgagtttatgggtccagagccaactatttattttttaaaggtccggaggatttttataaatactgtctttctaactcaattctgatcagagattgtgaaaattatgaggggctgtctaaggggtggttcaggatcgcagtccggacggaaaaggaaaacaggcggttcattcagatccttcaggcgttttcgaaaggagaaacagcatggcaaagacaatcatgattcagggaacgatgtcaaacgttgggaaaagtcttattaccgcagggctttgcagaatatttaagcaggatggctataaaaccgctccgttcaagtctcagaatatgtcgctgaactcatacataacaaaagacggactggagatgggacgtgctcaggttatgcaggcagaggcggcgggaatcgaaccgtctgtctgtatgaatccgattcttttaaagccttccagcgataccggctcacaggtaatcgtaaacgggaaagtccttgggagtatgagcgccagggagtattttgcatataaaaaaacactggttcctgaaatccaaaaggcatttgatgctttgagcagggacaatgatatcattgtcatagaaggtgcaggcagtccggcagagattaatctgaaacaggacgatattgtcaacatgggtatggcagagctggtcaatgcacctgtacttctagtgggagacatcgaccggggaggcgtctttgcacagctgaccggaaccatgattctgctgacagaggaagaacaaaaaagagtgaaaggaatgatcatcaacaagtttcggggagataaaacgatcctggagcccggcattgagatgctggaagaaaaagtgcagatccccgtcgtaggggttaccccatacatgaatcttgaactcgacgatgaggacagcctgaccgagaggtttgaccggaagacaaaaaaggaattggtcgacattgctgtgatccggtttccgagaatgtctaactttacagattttaacgtttttgagctcattcccaatgtgtctctgcgttatgtaaaaaaaacgggagaactcggagatccggatatgatcctgcttccgggaagcaaaaataccattgaggatctcctgtggcttcgtcagtccggcttggaaaatatgattctgaaagaagcctccgggggaacgattatttttggaatctgcggaggctatcagatgctgggagaagtgctgtctgaccctcatcatgtggagacaggcggaatggtcaaaggaatgggactgctcccgatcgacaccgtcttttccaaacaaaaaacaagaagccgggtagagggaaggttccttgaactggatggagatttatgttcgctctcaggagcctcttttgagggatatgaaatccatatgggggtctctactcaacatggtgatggaaagcctatgatatgtcttgaagatagagtgaatggtgtcaagaaaccatgtggaatttgcagggaaaatgtatacggtacttatgtccatgggatttttgaccttgcggatacggcggaaaagattgtccgtgccattggagaaaagaaagggatcaatctttccgatgctccggcgacggattaccggcagttaaaggaagatcagtatgatctgctggcagatgaactgagaaagcatctggatatggaaaaaatatatgaaatcctcgataaaggagcaaaagactgatgaagattgaacttgagaatgtggagcctgcacagatcgaggcaagaagttttgagatcataacagaggaactgggggagtttcctctgattcccggaacagaacctattgtaaaacgctgtattcatacaagcgctgactttgattacgcaaaaaatctttgcttttcggataatgtagtatcgcttgccatagatgccatcaaaaacggcgcatccattgtgacagatacgcagatgggcagggccgggatcaataaaaagaaactggcccggtatggaggaacagttcagtgttttatgtctgataaagatgttgcagaagcagcaaaaacaaacggcaccacaagggctgtggcgagtatggacaaagcggcggctttaggtgagaagttcatttttgcagttggaaatgccccgacggcactggtcaggctgtatgagctgatcagggaagggaaactggatcctcatctggtaataggggttcccgtgggatttgtcaatgtggtccagtcaaaagaactgatcatggatgctgaagttccgtacattgtggcaagaggaagaaaaggcgggagcaatattgcggcgtgtattgtaaatgcactgctttatatgatggagtgagggaaacgctgtcaggacttttacagtaaaaagaaggtgaaaaagtggaagagaatgcggcagagcattataaaaatttctgaatcctctgatgaggctgccgggcagtacggatacaatcctcctttatgccagaacctatgccgcctgtatccttatttccgcgcccttgatgacaagcagctttgttcttaacaatattctgcggtatgagggaaaggcatcattggctatgatcggtctgacagccggaggttttctgaatatttttggagactgggtactgatgacaaaatttcatatggggatcctgggagccgggatttcaacggcagtgtctcaggtggtggactttttcctatcctcacagctggcaggctggtttcggaatgatcccgctgtcattgagatcgggacctttgcgttaagagcccagcttctcacattgtttctgcagccaatgtcggtatgtgccaacatgatgttccagagcatcggaaaaaatgggaccgcttcctttttggcaatgcttcgaagcggaatctgctttatcccggtgatctttttgctgcctcgtatgttggggctcaccggagtggaagtatcccagaccgtggcggattttctgacatttgtgatcaccgttccgtttgtggtacagttctttcagcatcttccgaatgatgcctaggcatatcatcgtgaacatttcaaattggaaagggagaataatatgaagattgttgggattatgatacttgctgtggcaggagatgtgatcttttttttcgataaagacaatgaaagacagctggagggccgggatcgcagagaatgataaaactgaaatcgtaacaagcggaatctatcaaatcagcaggaacccggcctttctggggtttgattgtgtatacataggattgctgctcatgttttttaatccaatactactcattttttctgtctttgcaattataatgcttcatctgcagatattacaagaagagcagtatttaccaaaggtctttggaaatgactatatcaattataaaaacaaagtttaccgatactttggaagaaagtcctccttccgattgtctaaaaataattcacagcaacaatagccagtccaagtaccgtgagaaccgctccggtggcacggtttaatacaatggctgaagctttgttggcaaatttggctgcgaccctggcccagaggaaggtacttaatacacagaatatcaggcttaacatgtccgggcgtcctccgatggcaaaatggcttaaggatccggtcagtgctgtgaaggtcatgatgaaaacgctggtgcctacggcagtcttcagctcatatcccaggacactggtcagcagaagaagcatcatcatacctccgcctgcaccgacgaaaccgcagataaatcccacaacagcaccgcagatgacagactgaaggaatctcttttttgcgttcacagattccatgctgctttttgtggtcatgaccgggcggacgaggaacttaattccaagcagcaaggtcatgaaagtagaaaaaccgcccatggctgtgcttggtacaaggcttgaaatatagctcccaactaaagtaaagcatagcacggaggccatcatgaccaatccgtttttaatatccaggttcttatgtttgccataggtataggcagatacagcgctggcacacacatcgcttgccagggcaatgcccactgccatgtaaggattcattccgagaaaggcgatgagcatgggactgatgacagcggctgcgctcataccggcaaaacctgtgcccagccccgcgccgattcctgccaaaaaacaaatgataaatttatataacataatcgttacctcatacttgttattttttttctttcagtgactttgtgatattatcatcgatcctgctgaaaaactcctggagtttttcccgttcttccttagaaaaaccatccagcaaaagtgcaaagcattgttcctgacagccagccagggcattaatccggtctttcatatcagcagataggatcagccggtgcaccttccggtttacagggtccggagaagaagacagatacctctgcattctgagagattccacggccttcgagacattggatttggcaaagcccctcatgatggagatatccttggcagtattatgcattggattattttttagaaaaagcaagacatcaatttccagctgcgaaagtccgtactgatccgacaaaggctggaatgtctgccgatacaaatgcttaaaatggtttgcataggtcaaaacatgattctgcataaacattcctttctaatataagttatttttataacagttctaattataactatttgggcgcaagctgtcaataaattaaaaaatatgtcgggatgacacggtttagatatagttctattaggaattaccgttgacaaagaatcagatatattataatattgaatggtagttcaatattaggagggattatggctcaagtcttaaaagaagagatccggcaggggattctccatgcggccctggaggagttttatgaaaacggatatgtccggacgaccatgcgcagtatcgctgacagagccgggataccggctggtctcatttattcttattataaaaataaagaggctttgtttgatgaagtcctccgcccggtgcattttgactggaaacgggtcatgaaaggcagcggatcatcggaccatcagaattaccagtatctgagccagatggaagaggactgtatcagaagtcttttcagacaccacagagagtttatcattatgatggataaaagcactaagacaaaatatgagtgtgaaaaggaaaacctggtatgtgagatcgagggccatctgaactcgcaccgggatctgtgcaggcattacgatccagtgtttgtacacatcatagccaataattttttagatgcactattgcagatcgcataccactatgaaagcgaggagtgggccatgaaactattaaacaagatatcaaaaatgtatttacagggaatcggtttttaaaccggttcctttttttattgaacaatactgaatatatgttcaatattgaactgagtaggatttgtacggtctttggatccgttcagataaataaaaaatttggaggagaagattgaaaatgagaagtagagggtatccatttatttaatcgcataacaaataagccatcttccggtggctactttaaaaagtgaatattgaaaagttaaggttatgcagttgctgacttgatcttataaccttgattccttgctatgatgatggcctgttctaccgtgatttcacggtcaacagggggcacttctgattttcggtaaagttccgaattatagttttcaccgttcttcagcatgtgatataatgcagtaagaagcattcttgccacggcaatgattgctttcttgtgaccgcgacgctttttgatacggagataacggttacgaaactcaggatgcttattacttttaatcacagcgttagcacactgtactaaaagaggtttgatatagcatccggccttggaaacccggacagattttttcttccctgcactttcattgttggttggagcaagaccagcccatgagcacagatgtttcgccgaagggaaagcctccatgttggtaccaatctcggaaatgattccgatggcagtgaagtcactgcggataccaggagcggtttggagaatggcaagttcctgctgatagggagcggcgagcgcaagaatgagttcttcaagctctgctttccgggattccaggttttcataatgcgctttgatcaccttaagtttaccagcctgttccggagtgatatagccgtcaatggcatcccggagttcaggaagtttctttttcaaacttttgtaaacgagaggttcaaggtcaaaagaagtatctgcgggattttccaaaagtttatccagtatcgcctgagcagatttgccgaaggtgtccgaaacaacgtttcccaactggatattggaaaccgtgagacagttctgcaaacgattcttttcgcttgatttgaaacaggtcagtttgaaacggtaacgcataaggtcgcggagctgacggatgtcagcgggtggcataaagcttccggtaacaaggtcatgcttaaacaggtcagcaatccatttggcatctttcttgtcagttttctttccacggatagccttaacatatttgggatgggcaaggacaatcgtacaatcgttttctaaaacgttgtaaacagggatccaatatttaccggtggattccatacagacatccttgcagttatgtttgagaagccattgtaacaaatttttcagacctctcgtgtaggttgaaaaacgatggctctcataagtggtgacgcctttaccatcggtagaggcgatgcaggccactacaaaatttttgtggacatcaataccacagcagattttgtacacgatttttaaagccatagggactcctttcagaaccaaaaggttcactgaagattatagggagagacggcattgactgaacgcctaagccataaacgagattgtttatacaaagataagattacgtgctcgaagtcacacttatttgtgcttgaaaaggcggactacacatataaaaatacggtcatccggagagccggacagcccactcacctcctcgtgatttgtagtataccgagttccctacaaagaagaattataaagaaaaaataagctcagggaaatattttcataacgttttgtgcctgagcgaagcgaaaggaatggataaaaatatgaaagaagcgaaaaaaaacaattatcttctgggggaggagacggtggcaagagcgcttttaaaacttggcatcccgaccatgatcggaatgctgatctctgccctttacaacgccgtggacgcctattttgtcggagggctgggaaccagtcagatgggcgctgtctctgtggtcttccctattgtccagctggtgatcggacttggaatgatgttcggggcaggagcatcttcttatatatccaggctgcttggggcaaaagagtatgagctggctgaccggacggcctccacggctctgtttaccggactgttgacgggaggtactgtcatcgccgggatcctgatctttttgacaccggtattatccgcacttggcgctacagagaccattctgccctatgccagggattatgctctcatctatgtgaccggatcgattctcaatgtatttaatgtaacaatgaacaatctcctgacagcccagggcgcaacccggtttacaatggcagccatgatgaccggaagtatcctcaatgttattatggatccgttgctgatctatggactgcacatggggatccggggagcggcagcagccacggtaatctccctgtgcgtcaattcctccatgtacgtggtttacctgatgaagggaaaaggacttttgcatctgtctgtccgaaacatcacaccaagcaaaaagatatattctgagatattaaaaatagggattccggtactggtattccagctgtttgccagtatcgcattgggactgaccaatactgcggcaaaagcatacggggattacgcggtggctgccatgggcgcagtcagcaggatcatgaccgttgggatctacgtggtgtttggttttatgaaaggattccagccatttgcgggatttaatttcggagccggacagtatgaccggctaaaagaggcggtaaaactctgctgtctctggtccaccagcttttgtgttctcatgtcggccgtatgtttcctcttgtccaaacagctgatcggactatttggcactgatccacagatgatcctgctgggcggccgggctctgcgttttaatgcagtcttactgctgaccttcggattccagatggtgtatgcgtctctctatctctccgtcggaaaaagcggcgcaggaagtatcttaagcctgggaagacagggaatctttttctttccgctgatccttctgcttccgaggctgtttggactttcaggaatcgtctgggcccagccggcggctgatgtatgtgcggccctggtgactttgtggtttgcttggaacatgaacgaaatacttggaatcagctcaaagaagagggcatctggttccggggaggagtgtatacatgaaaaaggataaaaaaggcgccagccttttccggttgaccgtattgggtattgtcttaaatctttttctgagtatcctaaagttcacagcgggagctgtcagccattccgtgaccgtgacggcggacgggtggaacaacttaacggatgcggggacaacggccgtgaccatgttcggcctctgggtggcaggctgcggcgcggggaaacaccatccatacggacacggcaggctggagtggctccttggaatgctggcgtcagcctccgtgatcaccataggatttgaattgttaaaaacatcggtttcagccttatacagaggacagcaatcggactatcaaaccgccgtgttttttgtattgttcctctctgtggcagtaaagatatggatgtacttttatcaaaaaagggctggtcttgccatggagtcagcgacattaaaagccatgtctaaggactctttatcagatgcctttgcgacaggaacagtcctcatttctgctttcgtcacaaggttcactgagtggaatattgacgggtggtgcggcataggggttgcagtcctcatcctggccaacggcctgaaaagttttacagagatcgtagaaaaagtgatcggaacacagccggagggcagtattttgcaggaggttgaggatatcatatcaaagcaggaaggcgttgcatgtttttatggtctaaacatccatgactacggcctcaagcactacatcgtttccgtaaaaatattgggtaaggacagtggtatttttacaaaagccctggaactttctttaatgcttgagcagaagtacaactgcaactgtacggttcaggccgggatcgcggcagaagagtccaacaaaataaaacaactaagaaaagacctgaatgaaaaagcaggggagatccatccgctgctggagctcaaaaactaccgtttcatcagggcaggagaacataccctgatcacggcagacctttgcattcctatttcccttcagaagaaggaagatatgattttaaaagaactcagtcagacagcaggaaaggccggaatccagtatcaactggaactaagcccttttgtggaaaataaccatatccggtcctggaagactctgaagaaatctaaaaaacggaagggatggggctaagggttcatgtccagaaaatgactgcggtcagatacggcaaaggaagccatctgtccggcagagtttcggttcagcgccatgactctgccatgatacggatagtagatcaggttagaccagagaacctcatagccgcctttgtcatattctttggcagtgggcagatagctgtctaccccgttggtgtagccgttcaggaaaaagagtggattcttggatttctgccacacgtccagtgcaatctcgcacatgatttcatttgcaacaccgcagaaacagccgtcatttaacataaaataatgaaattcaatgtccgctgtctgcgtaaatatatgctgttcgcggagtttgcggacttccataagccatccgtttccgtctataccagcttcagtttcggcttcctctgcgatttcctcggcctgttccaaggaagggacatcagctgcaaacggatgatctacagaaaacattgccagcctgcagaccggctctgtctttaatttttttaacacgggtgcgacggaggaaaggacagaatctgccatgttctccaatgcatctagactttgctgaaaatacttctgtttttcaaagtcagtgtacggcttctctaaagcatccacaccctggatttccataaaatctgcattttcctgctgaaatcttggccggagatttccggatgccccctggaccatcataacagggcattcaaaagcattggaaagcctctgccttgtaaggccgaaataatccgaagaaaccttatagttgtcgcttgtgagcacattggcatgggctgacaacctgagaagaagcagtaccggtttcccatccggatccgccagctttaaaatcccaagccggggttctttggcggatgtatctgatctccggttgatgccgatcaaatgatccccgatcccccaagccgcatgaaatggtctcatttgtttctctgcctcttttgctgcgatacatatccgatcacatacaaaggaaaagtaagcgggttcctccgctgcattaggggcagaatgggtatgggaaaaacagaccatgatcttatctgttgtaatattgagaacgctggcaatcttttttcttagcttcagggtcagctccacggtaaaacccaggctgtccacagcagccaggcagatggtttcttcctgggatctgaagatgaggatctgggcatttaatgaatgaaggattcctctggattgattatcaattctcggaaaccctaccagctggaccggaccatccggggtaatattagtttcggcaaatccgaaagaagcagtgttttggttttgtttcatgagtaacacctcctgtatcaaaagataacagaagtggaaagagccttcaatatccaaaatcatacagaaacaatttataccttaacgcgcgaagcgtgtgcacccgaagggtatgaaatacggtgtgccctgtgggtataccttaacgcgcgaagcgcgtgcacccgaagggtataaaatacggtgtgccctgtgggtataccttaacgcgcgaagcgcgtgcacccgaagggtataaaatacggtgtgccctgtgggtatacttatgaagcagattaccataggaagggaatgagacgggattttgttatttgggtatatttaagatagccgtccattcagaaaagcagtgaatatcaagtgatagatatccactgctttttcagatgttttcagcttattcatctgccgtatacaatctttcgaatggtatgtacggaaagaaaatatgtatctgacagtttttctatggacatccctgaatgataatcctttcggatacattgattgcgctgggaagtcctggtccggctccctgtctcatcaccccattttttatgctggtcttcttttttaggtatgtacagataacctccctgtacatagtcctgaagctgttccaaaagggatgcgggaagaatggaagctgcatttttataattcataattggtctcactccttaaacagtattgtttttggaaacaaggccgttaagaatatgaaagcgccttttactccatgcagccggcgcttcttttattccataggaaattcctgggccctgcatggagacttacatctgcttttctttttttattaatacacataatgatcaccgcctattgttcgtatttctgcatttcctgtttaatagaatcttcacaggagcgcatggctagtattgttttttcaaaaagctcgtttaactcccagcccagactttgggcgccctgggagatcacatcccgggagcagcctgccgcaaactttttatctttatacttcttacgaatgctggacagtttcatatcctggacacttttagaagggcgcatcaatgcggcggctccgatcaagccggtcagctcatctgccgcaaataagactttctccatctggtggtccggctggatgtcagaacagatcccatagccgtgggaacagacagaacgtatcatatcttcccctacgccgccttcccgcaaaagttccggggccttttggcagtgttcctccggatataattcaaagtcaatatcgtgaagaagtccggtgatgccccaatagtcttcctcctgtccgtaacccaatttattggcataccatctcatgacaccttccactgtcagtgcgtgttggatgtgaaagggttctttattatatttttttagaagcttaaaggcttcatcacgtgttattgttgcttccataggtcctcctttgttggtatggtgttttatcatttgctttggttttattttagcacttgagatggggaaagtaaaacagcgaaggacgggatcttatgacggttttgggtttgacattcatataggaagatattagaatttaaggagaaagaatttcaagaggggaattacaataaaatgaacgcatttctgctgatggtaccactttttttcataagatttatcctgttaggacaaataaacaaagaagcattaagccgtgccgctttttttgctccgttggagggcagagagaggacggcatacttattttatcaatgttcaaatatttttattttcttatattcttttttattacaaataaggattggtactctgctatcctttattgccctaataatatatgctgcaggtattggcattcttacaatttcaaccattgcatttgccaaacctaggcaggatggattaaatacaaacggaatatataaggtttccagaaatccaatgtacatcggatatttcatatattttttaggatgcgttcttttgactcgttctattttgttatttcttgcactttttatatttcaaatatccgcacattggatcattatttctgaggaaagatggtgtattcatgaatttggggatgagtatttaagctatatgaagaatgttagaagatatctgtagggcattgataaaaatgatgtattttacaagaaaggaaatgtaggggttgcgtttttataaactccatacaaaggaatgaacttgaaacctattgtgtataagatagatgatgatctaaatagtttacaaattttacaggagaaattagaaaataaaattttggaaaaagaagtattgtttgattatccgacagtttatattcatgactggaaaaagggagaaggttatgaggtgtatgttggggagtcgaataatgtgattcagaggacaaagcagcattttgatcaatcaggggataaatcaaaatggcagtatcaactgaaaaagaaaacatctagtttatatattatcgggtatggtcatttcaataaatcttttaccctggatattgaaaatcgtttaatgcattatatgatgggagcagaatctgttaaaagaatgcacaataagaggacaaatcctcagaacagatattatcccgattgtgaagcaaatgctatcttcagaaaaatctggaacaatttaagaaaaaaagatgaagttttatttcctgcagagagtgagataaaagattccgctttatttaaagcctcccctttacataagctaacgcaggagcaggaagagataaaagaaaaaataattgagaaggtttttactgctttggataaggagaaacagggacagcttatattcattgacggtgaagcaggaacaggcaaaactgtacttaacagcagtaccttttatgaggtgtttttgaaggcagaggagcgaaaaaaagatgatcttcagtgttatttaattgtaaatcatgatgagcagataactgtctataaacagatagctgagaaacttggtctaaaaaataaagatggaaaagaagttgtgtgcaaaccaacgtcatttatcaataatcattcaatggatgagccggttgatgtagcatttattgatgaggctcatttgctgctaacacagggaaaacagtcataccaaggaaaaaaccaacttgaggatattataaatagggcgagagtcacagtggtgatgtttgacgaaaatcaaattttgacgacagagcaatattgggaagaacagattttaaagggttatagagagcaagccaaagagagtgataattattttgaattgacaaaacagttgagagtgactgcatcggacgaaacaatttcatggatcgatgactttacaaaaaagaaacgtatatcagatattccaaaagataagaccggatatgaaataagggttttttctcagccgtcagagcttgagaaagcaattaaagaaaaggcgggggaacaagaacataaattatccaggctcattgcaacttatgattgggaatatagcaaaaattcatcaatggaaaagagaatgaagaaatattgggaggttttgatcggtaattggcataaaccatggaaccgtgagttggaaaaagacatggaaagaaaacaaaagcggaaaaataaaacactttcctgggcagaacagccgcagaccattgatgaggtaggatccacatttacaatacagggattcgatttgaattatgcaggtgtaattcttgggccttctgtaaaatatcgtgatggaaaggttgtttttgatccaagtgcaagttttaatgaaaaagcaaaacgaaatcgtacattatcagatggtaccatgaagaaatttggagaaacattgatccagcatgaagtaagggttttgatgactcggggagtcagtgggttgtatatttatgcttgtgatgaagaattgagaaaggcattggaggaagctgtcagatgagagaaattctaagatagaaatattttctcgattatatcgtatctgtggatgttgtggctctgcgaaattatgagtgagattgtcggaattttatattgttccgataagtgagaaatattattccgaaagcattgctattattccgagtagagggtatactacttttgaaagtgaggtacgaatcccctcattcgaggacaaagtggttcagggcgtattcaaggaaatacttgaggcaatatatgagccaaagttcaaggagttttcttttggattccggccaaataagagttgtcacgatgcaatccagagagtaaacagacacatcatggcagacaaggtaaattatattgtggatgccgatatcaaaggcttcttcgataacatcgaccatgaatggatgattcaatttctggagcatgacatagccgataagaactttatacgatatatcaaacggtttctgataggcggagtcatggaagacgggaagcggctggaaacagaagcgggaacagtgcagggaggtctgatgtcgccagtgctggcaaatgtgtacctgcactacaccttagacacgtggtttgactatgtgaagaagcgcgagtttaagggagagatgtacatggtgcgttacgcagatgattttgtatgtctgttccaatacgagaatgaagcacggaagttctatcagcttctgattgagagactgaagaaattcggactggaaatcgcagaggataaaagcaggatacttccctttggaagatacacccactggaaactccaaagatatatgtaacaagtgcttattaggcgaatggcttattgaagagccgtatgccttaatagggcacgtgcggttctgtgaggggcttttgagacttgaacctctcatcgcaagagaatatagatgaaaggaagtgaaaagtcgaggcaaagtctactcgacgactttttatgaaattatgtattgcagtcactggaatggtctaaaaaaacacgaagcaaagataggagaagtgctatgactattccagatactaaaaaaatttatccaagagccggtgacagccagacaatttatttaaaaaatgtgatcgactgtccgaatatagaagtcggtgattttacaatttacaacgattttgtacatgatccgagagattttcagaagtatagtgtgttgtatcattatccgatcaatcatgacaaagtgtatatcggaaaattttgttctatcgcgtgcggagcaaaatttttgatgaactgtgcgaatcatacgctgtcttctctgtccggctatacgtttccactgttcggtgaagaatgggggcacggcattacgccggaacagtcctgggacaacaagggagatatcgtcgtgggcaatgatgtatggatcggctttgaagccgtgatcatggcgggtgtaacgatcggcgatggtgcagtgatcggcacgcgtgcagtcgtgacaaaagacgtaccgccctatacgattgtcgccgggattcctgcaaggccgatacgaaggcggttttctaaagaagatatcttgtttctacaggaaatcaaatggtggaattggcctgtggaaaaaatatccgaagccattccctatattcagtccggtgatataaaaggtctgaaaagcctgatactctaaacatttggagagtatgaaatttaaacccggtatagccgaacaggctataccgggtttttaagtatgacgggcatgtccgtgttctgtggtgcaagtccacataggcgtagctaccgacgaacttgtaagcgactcccaaggtttgcatcgtgaggtgtgggcgagaagaagggatagcgaaatcgtagccctacggacagaaacccgatattaaggcgtacatggtgggtaagttgacttaaagcaacgaagccctaaaggtagccgtaacccatgtgcgtaaatcgggagggtagacgaggaaagaacacggacttatcccgtgaggtctcacaggcggtttcatcagccgtagtaacaacgaactgtgagaagtcagcagaagccatagtaggagaaatctgaagggctgaacaatgtaaccgtgcagacgaatgtatgtacctgtgagtattcgacaagcggatgtaggcgaaacgtatatgagctgtaaacgcataaacataggacaaatcacagggagcggaaaggagcgaagcacacaaagtatgtcggaattgttggaaaagatactggagaaaaagaacatgaacgaagcatataagaaagtctgtgccaataagggtgcaggcggcgttgacggcatggaactggaagaacttgatggatttatccgtaagaactggaacagtatcagggagcaaatcagaggaaggagttacaaacctcaacccgtgaggcgtgtagaaatcccgaagcctaacggaagcaaaagaaaacttggaataccgacagtcatggacagggtaatccagcagggtatagcacagataatcagccctatgtgcgagccgctgttttcagaccacagttacggattccgtccaaacaggagctgtgaaatggctatcaaagatatgctcatgttcctcaatgagggatatgagtggatagtggacatagacctagagaaattcttcgataacgtaccgcaggataagttgatgagccttgtccacaacatcataaatgacggagatacggaatcgctgatacggaaatatctgaaagcaggagtcatggtgcagggcaggtatgagaaaacagaacagggaacgccgcagggtggcaatctgacgccgctattgtctaatatcatgctgaatgaactggataaagagatggaaagacgtggattgggcttcgtgaggtacgctgacgactgtgtaatagcagtcagaagcgaagcaagtgccaaacgtgttatgtattcgataacggactggatagagaggaagcttggtctgaaagtaaatgcagataaaacacacataacaagaccaatgaacctcaaatatctcggctttggattctggaaagattccaagacgaaagaatggaagtgcagaccacacaaggattctgtgcagaaatttaagaggacgttaaagaagctgacagaaagaagaaaatcaatggcgtttgcggaaagggtaaaacagctcaacagggtaatccgaggttggataaactactttgcaataggtaggatgaaaacagcaatgaccgacatagacgcacatttgcgtacaagactgcgagtaataatctggaaacaatggaaagtaccgaagaaacggcagtggggattgcagaagctgggtataggaaaagaccttgcaagacagacatcatacatgggagaccactatcaatggatagtaacgaaaacctgtgtagtcagggcaatctcaaaagaaaagctgaaacaggcagggcttgtgagttgctacgattattacatggaacgtcatgctttgaagttatgttgaaccgccgtatgccgaacggcatgtacggtggtgtgagaggggagatttaatctcccctactcgattgcttctgtgtttttgtaataaacctaaaaagcaggatcattccaatcagactgacaagcagttcggtcatgggaaaggctgcccagactcctgtaatgcctcccagggcagacaatataaaagccataggaatgataatgacaaatccccggaggatcgatatcatgtgtgccggccgggggtattccgttgaagtgaagtaaacggcagccacaatattgaaaccagcaaatacagaggctgtaaagtatattttcagtcctgcggctgcgatatcctgaagtgtcttattgtgattgctgttaaagattccggtaatcggttccgcaccgaaaaacatacacagataaacgcaggcggagattacaataaccgcggtgacagcgtaacgtaaaatcgcagtaacatttttatggtttccggcaccgtaattgctgcttaagacaggctgtatcccctgtgcgatgcctgtatagactgccatgacgaccagtgacagattcgcgatgacaccataggccgcaacgccgatgttccccgcaatgtgcagcaggatcacattaaatacaatgatcacgataccggaagaaacttctgtgatcaaagacggaagtccgcttgaaaaaatatcaagcagaaggtttgccgaaagtctgcatttctttaaatgaaactgatttcttttatttatcagataaggggacagaatcaaaatgctgattaccggtgccagtccggtggcaaacgctgccccgaacaatcccattccgagcggaaatataaatatataatccaaaataacattagacagactgccgcagatcatggctgtcatggataactggggatttccgtcatttcttatgaaacacagcaaaagattatttgtcataaaaattggggcaaacaacagaataacctgtaaataagtttttgtcattttgaacacagattcgttggctcccaacatactgaccatagggccggagcagaaaataccaagcaggaagaagatacctgcgatgattccggtcaaaaccacagcatttgtaaatacctgattcgctttgactttatttttctggcttcttagaattgaatattttgttcctcctccgattccgagcattaatccgctgccgtttataaagctgtaaaccggaattgcaaggtttaaggaggtcagtccatcagcgcctaatgccctggagacaaaaaaggtatctgccaggatataaaaggacaaccctaacatacccagtacattgagcgaagaatacttcaaaaaaactttaaaacatgagatctctttcatatggtatataccttccttatgcatttgtgtacatctccgcaggactttcctatggcataaaaaacgtcttactcattccaacaaaggcctactggaatgaataagacgttacccggcggtaatgaacatttatgctattttttatagaatatcatattgactgagaaagtcaatatctaggtacaggatttcgcgtgttctgcaaacagctccctgaccccgtcatattccccgagtcctttcattacacattctacttgatatcccgccgacacaaactgagagtaccaggaatccgggtcgtctcccgccatatcatgtcttgcatgatctccggccacgatcataaaaggcgcaagaatgactttcttcggatggaattcttttaccatacgcatcagggaatgcatattcgggaaggcttctactgtacccagaaagatatttttaaaccccatatccttgaaccggtagtcaagggcagcatagacagtattggcatagtgagtagtgccgtgtcccatcagaaccaggacatctttgtcagagatccacgaaaactccgatgccaccgcattcacaaccgtttcattgtcggattccgatgagagaagaggtgccccgaagacaatagaatgaaaagagtcccggaaggaaagagcgtctgttttcatctgatcgttttccacgccgttgatcacatgggtgggctggatgatcacatctgcaatgccgtcggctttcatgcgctccatggcttcgggaacagagtcaatatggattccgtctctcttttttattttttcaaggatcatccggctggtccaggcacggtacattttgtgatccggaaaatgttcttttaatgtatcttcgattgcttcgatcgttttttttcgtgtatcttcatagctggtcccaaaactgaccgctaatattgctttttttctagtatcgttcattattctcctccgcagacagggaatcttcagattccttcgatgaaatgtaaaagctccatgagacttctgggagccggaaatttctcattgatcatctttttccggcaaagactttcatatatagagagtacagccggctgagacaaattggtgaggttaagagccggcctgtcagaaaatacttccaggggtgatccggctttgagaactttgccctgatgaaacaagatgatctgatctgcccatgaaaaagcatagtccggatcatgagttgagatcagaaccgtaataccggattctgtcatctgatcgatgattttatttaacatgtctgtatgcttcgggtcaagggccgcggcaggttcatccagaatcacaatatcaggatgcatgacaaggatatcggcgacagccacctgttttttctgtcctccgcttagggcatgtgtagggcggtcttttaattctgtaatatccagcgcatccatgattttttccgtctctctcagggctgtctcattgtctgccccaagatttaaaatgccaaaagaaatctcctgccggacactggctgaaaacagctggttatcggggtcctgaaatacgatgccgatcctgcttctcaaatttaacaggcttttcttatcataggaataaggggctccgcaaaaagacagggcgcctttctggggacgcaaaataccgttcaggcagagaaaaaacgtggactttccggaaccgtttgctcccataaccgcagttttgctccccctcttaatatccagagaaagcccctgtaaggccgggatatcctctccgtcataagtaaaccacagattatcagctgttatcatagactctgttttcatatgtaaatattccttcctatcgtgatagacagcagaagaagttcaaacaatatcatgcaaatgatttctttcttcttcggcggatattcttccaaaaggacccgtatggtcccgtcgtagcatctggattccatggcatcgtataatctgccggagcgcatcactgcccgaatgaacagagcagaggccatacctccgaatgcacggactgccgtcttaaaattccggcaggaaagcctggactcctgggaaatccttacagcagaagcctctgacattaagacaaaaataaaccggtaaatgagcagaaacaattctatgagcagtgccggacatctaagtttctttaaaatgccgatcagatcggttaccggggttgacagggacaaaaaatataggcaggacaccgcggaaagggatgacaggatcagtctgagaccaaagatgaccgattcggtgcttcctgttatatagtagggacctgccggcactgcataggcatccagaggagttttggaaatattgacgaggatcgccagcgtgctcaagagcaggaagactgcggggatacgcattagctttatataccggcggacggggatacctccttttcttattgtcagccatccaaggcttaaaagaaccagaatggaaacagaaaaagatctgctcaggatacagagcagaagcgtcgtcacagaaaagcagaacttttccatgacgtttacttttctgagcccggaccggtaaccgtattgatcaatcagcatcatttgccgcctctgccgaagcaaggagacgtttccgttcccttaaacgtcccaggttataggcaatgatcccgacaccgatcccggtctgtacacagaacagaaggctttccacttcgcccggaagctctccgtcaatgaaagtttccaggacgggagtgaaccatggctgatattcccttccctctatctttgatatcatgacactgcccgcatcgtcagagcctccgaactcggcgccctttagggtaaacagagggaccacagcaataaaggcggccactaaaagcaggatgatgacttttttcttatcacttttcatatgcatgtccctccttgatgaagtcaagaatcttgagttccgggcgggcataggactcaagcgagatgatgattacaacggtcagaattccttctacgatggcgagagggagctgggttggagcaaaaactccgagaaattttgccgcggaggccagaaagccaccctgctctgatggatacgcaagtgccagctggacgctggtgatgcagtatgtaaaaatgtctccaagcattgcggccaaaaatacgctgatccggcggttcagccggcatttttgacagaccttatacactgcgaaggataaaaatggccctgcaattgccatagaaaaagtattggcgccaagggtcgtcaatcccccgtgggccaagaggactgcctggaagatcagcacaatgatgcccagaatgctcacagccaaagggccgaacaaaatggctccgagtccggtgccggtcatatgagaacagcttcctgtgacagaggggatttttaaagaagagataacgaagataaatgctcctgacatagccagtatcgtcatcagacgccggtctttgctgaccgtctttttgatggagaaaaatcctgcggctaaaaacggaaggctcagagctccccaggagatacagagctgtggaggaagatacccctccatgatgtgcatggcgctggctgtgcggccgaagccgaagatgacagccgccgccagtacagcggttacaatgattttttgattgtttttcatgtttgctcctttcgattcacttaactgtgtttcggtgtaaaaactgcaacaccaaaagcgccagatatactggtgcatcgaatataggcgcagaagggcgcggctccttcgacggtatattctacaccggctgtctttcgcagaccggtgtaaatcgcatgttcacggcaggtcttctgactcaggcttcactgccgcattccgccttcccagtttcccagtgacataattgaaatgcggctcttcctatacagcggcgggaccgtgcgggaatctcacccgctttcctattctcctttatcaaaggcacctgtaaacattcaatttctcccattttatcgagttgttagaaccttgtcaatatgctatgatggaaataaaaaggagaaattaccgatgaagactggaaaagtatggctggtgggcgcagggcccgggtccatcggccttttgacgataaaagcagcggaagtgctgaagaaggcggatgtgatcatttacgacaacctgatcggcaccgaaatattatcggcacttccaaaacaggctgattacatttatgtcggaaaacgttccggacagcacacgatgcctcaggaagaaatcaatctgctgcttcttaatgaagctcaaaaaggccgttttgtcgtgcggctgaagggaggagatcccttcctgttcggcagaggaggagaagaactggaactattaaaagaacactatattccatttgagatcgttccgggcatcacctcaccggttgcggtgccggaatataacggtatccctgtgactcaccgggactttagttcttccgtgcatatcataaccggacacaaaaaagcaggagcagaatatgatatcgactttgaagctctcgtgaggacaaaaggtactctggtgtttttgatgggtatttcatcacttccagatatcgcaaactccctgatctctgcgggaatgaaccctcagatgccggcggcagtgctttccaggggaaccacggcaggacagaaaagagtttctgcgccgctttgtgaacttcctgaggccgtgtgcaaaagccggataaagactcctgcggtcattgtcgtcggacaggtgtgcagactttcaaaagattttgcctggtatgaagatcttcctctggcgggatgccgcattttactgacccgcccgaaagagcttatctcaaagacggctgccatgttcagggaacaaggggccgaagtcctggaaatgccttctatcagcatagagccggcaagagaccagaggaaactttccatggctcttgaaaagatcgatttttatgactggatcgtgttcacaagtatcaatggagtcaggattttcttcgaagaaatgaaaaagcagaaaaaagatatcaggagccttggttcctgcaggattgccgccatcggtgcgggtacgaaaaagacattggaagagaaaggcctgttctgtgatctggtacccgaacattatgacggagtttctctttccagggcactcgcggacagactttcaggtacggagcatatcctgatgccgcgggcagcttcgggaaatcaggaaattgtacggattcttcagaaaaagcccgggattcagacagatgatataggaatctatgagactcgatgtgagaactggcagctggtccctgtaaaagaaatgatcgaatcgggagagatcgattgggcagtctttacaagcgcctccacagttcggggatttgcggccgccctggcggatacgtgcatcaaagggatgaaggcagcatgtatcggagagcagaccgcccaggcggcgaaagaatttgagatgaatgtatatactgcagagcaggcatcggtcgaaagtctcgtccgccttattttagaacatcagacaggaagtaaattatgaagaaagagaaaaaaaactatcaatttttccggcacagagactgtgagtatttcccctgccatgaaacggatgatatcgataactttaattgccttttttgttactgtccgctttatatgcttggggagaactgcggcggcagctttagattaaaaaacggcgtgaaagactgcagtcagtgcatgatccctcataaaagaaaaaattatggctatatcaccggaaaattttctgagattgccgctgcaatgagagcttccggagatcagcagcagaaataatccttccttttcagttccgcattcattgttccgattttctcttatgaagccgatatatctgacatatccttccgcattagttccataatagtgtcctgctctgcagcgatggctgcaaaagctgcactcccgatgactcataaatttattttcattttgatatcctgttcctgtcacgtttgaaagacggctttcttatgaatcatataaatagaaaatggatgacaaaattcgacataaaagaagaagcattttcaaatccatctttttgtgtgcagagagatgacaatacatacgtctacgcatctagtgaaacgggaaaccttttgtatataatgaaatacatgtatgttaaaaccttatagataaggctgtgaaaggatatgagagagagaaaataataccgattggagccatgcacatggaacgcagattgttgggtaagaggattaaccagattcggaaagaaagagggctgacttccgaagctctttcagaaatttgtgatgtaaatgccggacacatcaggcagatagaatcagggatcaggcttccaagtctgcctctgttcatcagaatatgtcaggcattaaaaacagcaccaaatgaaatattaaaagatcaatttgatccggaaataattgagagtgaaaataaacttctcctgaaagtagaaagtttgactcccaaacaaaaacgtatattatcagatttgctggatacttttcagaaaagtatgaacggagattctgtcgaatagagacggattccttcattttatgtctgtcgaaaagaatagactttttcagaattttgctttactctataagcatgagcagtgttacttttaagataataaaaggagcaaatatgaaatatatgtctgaagtttttttagagttgcttggaaatgattttagtacagagaatgtgaggcagaccgctgccgccgtagggaaattactgaatgaccgtacaaccgaattaagcggtcaggaggcaagggacttatgggatgtcatgaaagaattttcctatctgatcgacgattgttctgtaaaacagaaggtccttgccaaagcaaatgctacatacagtttttctgtaaatttgtcgaataactaaaacttcatcttttatcattgaaatagcggcaatcaggcagggggtatctgtactttcagatacttcctgtttctgttataataaaaagcggaaaaaatatggaggatttacatcgtggcaaacaaattttacgcagtcagacaaggacgtaacccggggatttatcgcacatggaaggattgtcaggcacaggtttccggatttccgtgtgctcagtttaaaagctttcctgcattgtccgaggccgaggcatttcttaactcttcggccgggcaggatatggagatcgacggccagaccctgacagcctatgtagacgggagctatgaccatcgaaaaaaagaattttcatatggcatggtcatcagaaaaaaagagggagaattgtattttgccgaaaaatatgcagatcctgcgttagcctctatgagaaatgtggccggcgagatcaagggcgctcaaaaggcaatgcagtatgctgtggacagaggctatcaaaagctggccatttactatgattatgagggaatcgcaaaatggtgcaccggggagtgggccgcaaagaaagaggggacgaaggcctaccgttccttctacaatggtgtgaaggatcggcttcaggtacggtttgtaaaggtaaaaggccattccaatgatgagtacaatgacagggcagatatgcttgcaaagtctgcgcttggcatcggtgacggaagctttgtctcagacggatcagaccggtggatgccgcaaaataatcaagagaaaaagtgaggtggaggatgttggctatactgttcgatgtggatgatacactctatgatgtgtccatacctttttgcagcgcatgcgagaaggtttttaaagagagatattccattccttctatggacctgtttctggcgggaagaattcatgacgtccctgttattgaaagaatccgcaaagctttcaggaaattcgggattcagattacagagtcagaggtgatggaatttcatgaggtataccggatagaacagacaaagatcacgctgacagaaggaatgaaaaacattctggagttttgcagacaaaaaggaattttcaccggagtcataacaaatgggttctcccgtgctcagtggaacaaagtaaagaatcttcacctggaagcatggatacctgacagccggatcattgtatccggggacgagggagtccgcaagccggaccccgggattttcaaactcgcggagcagagatttggacttgacaggaaggatacatggtttataggggatacatatgccacagatataagcggagctataaatgccggctggaatagcatttggctgaaccggagacaggatattctgccggacggcaaagtatctccagactatacggtgtcagatgaaaaaggtctgtttaacatcctgcactcaaaatggtccgactgaaatatgcatctggaaacagggaaacatctctgggttttcagatgctttttttatgcattaggtgtataatgaaaaaaacattttgacttcagaagggggtgtgaggatggatgcgattgtaaacaggctggctctatcgcaagcctgaccgcatatctcttctataaggaagaggagatacagagactgatcaccattatggaacgcgtccgttacggcctgcctcctgaacagacggcaggttatatgaaaggagttatcggggtatgattgttaagatgaagtttataactctcacgggcccaaagcgcgacatcgacagagtcaccaacgattatctgtcaaaatacgagattcagcttgaaaatgctttgtcggaattaaagacggttgataacctgcagccgttcacggatacgaacccttataaaaagcctctggaacgggtcgataaagccgcagtattcaggctcaaaaagaagcactggagcttgaggaaaagcatctcactgaacaaataaaaatgattgaaccattccgccccatgcagtttgtcctgagagaagtgttccactttcaattcgtgaaattccgcttcggacgggcacctttggaatactttgaaaagatgctggagttcatcgaacacaatcaggatgtgatctttgtagagggggtacgaaataacagctacgggtatggggtctattttacgtccaggtccaaatcggaacagatcgatgccattttcaagtctcttcactttgaaaggattttcatcccggacgagttcatcggaactccggaggaggcttatgacgaccttaaccgaaaactttctattctcacagaaaaaaagaagactctggataataagatgacacagacactgaacgaaaatgcggataagatttatgctgccagggaaacctttttgtctgtctgatggaaggaggtcttcactatgaatacattaacaaagcttgtgctgattgcagccttgattttaagcgttttaataccgttcggatactatcggcggaaggaatctgcctttatgggctggtcatcgcctttatgatcctgggaaagctgtgagccatgaaaatgtttttgatcagtgataatgtcgacacttgcacaggaatgcggcttgctggcgtggatggaatcgttgtccacgaaaaagaggaactctcccgcgcacttgagaaggaatacgcggattttctgttccggggaggtgagaaaaatgtctgaggcaggccgtatatacggaatcaacggaccggtggtctacgtgaagggggatatcgggtttaaaatgtccgagatggtctatgtgggaccggaaaaactggttggagaagtgatctctctggacaagaatgcggctacagtacaggtttttgaagatacgaccggcatccgtcccggagaccaggcagaggcctccggatatccgttttctgtgtcactggcaccggggattctccacaatatttttgatggaattgaacgccctcttgaacagatcgctgctcagtcaggcaaatttatcagacggggaacccaggtggattccctggattttcaaaaacgctgggaaacacatattgccgtagcagcgggagagcagataaaaccgggggatgtgatagccagggtgccggagacggccgccatcacccaccggtgcatggtgcctcccggtgttcagggtgtcgttgaaaagactgtctgcgacggaagttataccatcgatgaaccgttggtcacagtaaggcaggaaaatggtgatctcagggaactttctatgatgcagcagtggcccatcagagttccgagaccggtcagtctgcgctatccggcctccaggcctcttatcaccggtcagagaattctggatacgatgttccccattgcaaaaggcggtacggcctgcatcccgggcggttttggaaccggcaagactatgacccagcaccagatcgccaagtggtcggatgccgacattatcatttatatcggatgcggagagcgcggaaatgagatgacacaggtgttggaggagttttcaaaactggtggacccgaggaacgggaatcctttgatgtaccgcacagttctgatcgccaatacgtccaatatgcctgttgccgccagggaagcaagcatttacaccggactgaccctggccgagtattacagagatatgggatatgacgtggcagtcatggcagattctacgtcccgctgggcagaagcgctgagagaactttccgggaggctggaggagatgccggcggaggaaggctttccggcctatcttgcctcaagactgtcggccttttatgagagggcgggaacgatgatgaatttaaacggcacggaaggctccgtatcgatcatcggcgcggtatcgccccagggaggcgacttttcagagccggtgacccagaatacaaagaggtttgtgcggtgcttttggggactggacaaaagtcttgcatattccagacatttccccgctatccactggctgaccagttacagcgaatacttaaaagatctggctccctggtatggcgaacacgtctccatggagtttgtggaccacaggaatcgcatcatggctctcttaaatcaggaaagcggcctgatggaaatcgtcaagctgatcggaagcgatgtgctccctgatgatcagaagctgatcctggagatcgccagagtgatccgtcttggatttttgcagcagaatgcctttcataaagacgatacaatctttgaagctgtgatatccatgaaatatgatgtgcccaatgacaggctgaagatgtttgatgaatatcgaaaagcggtggatgatttttaccggaagataatcgagaaaaacggttaaattgtctgcagtgtaaaaggattgtacctgaaaggagtgtttaacatgccgattgaatatttgggacttgacaggatcaatggtcctttagtggtactggagggctgcagagatgctttttatgaggaaatagtagagtttgtcatagagggaaacaggaaaaaacttggtaagatcatcgagctttatgaggacaaggcgatcatccaggtgtttgacacgacagataatatggggctttccaatactcatacaaggcttacgggacatcccatggaaatttctctctcccccgacatccttggaaggacattaaacggccttggaaaacctatcgatggactggggcccattgcgtcgaacgtaaaacgcaatgtcaacggactgcctctgaatccggtccgcagggagtatccaaggaattttatatgcacagggatttcggcaatcgacggcctgatgacactgatccggggacagcatggataacttcggcatcgtgtttgccgccatgggtgtcaaacacgacgacgcggattttttccgcaggacatttgaggagagcggtgccttaagccatgtggcgatgtttttaaatatggctaacgacccggtagctgagaggctgatcacgcccaaggtggcgctgactgcggcagaatatctggcctttgaacatcatatgcatattttggtcattctgaccgacatgacggcctttgcggaggccatgagggaagtttcctcctccaaaggagagattccaagcagaaaaggatttcccggttatttatacagtgaactggcaatgatctatgagagggctatacaagggaagatcatcaggacctggcaaaccagctgttctccgcatatgcaaaagtggggaacgccagaaatctggcctctgtcatcggggaagacgagctgtctttgatcgacaaaaagtatttagagtttggaaaagagtttgaggaacggtatatcgaacagggaagtgaggaaaaccgcacgatgacagagaccctcgatctcggctgggaacttctcactattcttccgagagaggaactggaccgtgttaatacgaaacttctggaccgttattatcgaaagaccggggataaggatacttattccaaaaaaccggaggacagcaggcctccggcggcaacagattctttgatgttttagcccaagctgaaagaaaggagggggacgtatggatccaaggacttttccgactaagggtaatctgatgatcgctaaaaactctctcgccctggctatacagggatatgatctgatggacaagaaacgaaacattctgatcagagagcttatgaacctgattgaccaggcgaaggatattcagaaacagatcgatgtgacctttacttacgcctatcaatgtcttcaggccgcaaatatcgaacacggcatcagcgagacagaccagctggcctatacggtgcccatcgaggattctattcaaataaaaagccgcagtatcatgggaacagagatccctctggtgacttatacaccggatcaaaacattccgacctattccttcagcaccacaggggaatccatagacaaagcaagagaggctttccggaaggtcaaagatctgaccatccggctttccatggccgaaaactctgcctatcggctggcggccagcatcaaaaagacgcagaagcgtacaaatgccttaaaaaatattacgattccttcttataggagtcttgtgaccgagatatccaatgccctggaagagaaggagagagaggaattcaccaggcttaaagtgatcaaacggagaaaaaataaagcttaacggacaggagagtactatgtgcggaagatattttacagacccttcagtggcagaagaactctatgatacattcaggattcccgggacagaagatgttgtcccggcggcagaggacgttcatcccgcggacactgcggatgttctggtacgcacaccggcaggaatcggacttgaaaggatgagatggggatttcccggttttgaaaaaaatcagctgatcttcaatgcgagggcggagggcgcactcgaaaaaaggatgttccgggacagcgtccgtaccaaaagaatcctcgtgccttcccgcggtttttatgagtgggacagcaaaaagacgaaatatacttttcaacgtacagacaaaaaaccgctcctgatggcaggatgctggaatcagtttggcgcctgtcagcgtttcgtgatccttaccacagaagcaaatgaatctgtgaagagtgtccaccacagaatgcctctcatcctggacccggaagatgcatggatatggcttatggatgacagacagaccgaattcatattacagaaaatacccggcccactggaaaaaaagtctgactatgaacagatgactttttcttttttattccataaggaggaacctttatgaccattgaccgattagtaaaacttcagagaaatttttattatacaggtgcttcacaatcatatacttttcggatggaagctctgtgccgtttagaacaggcagtaaaaagccatgaaaaacagctgatacgtgctttgaaaaaagatttgaataaatccggctttgaatcatatatgacagaagtcggattgttttacagtgaaataaactatgcaaaaaaacatttaaaagattggatgaaaccgcagagaaagcccacgccggttagccagtttcacgcaaaaagctttgaaatctccgagcctctgggtgtggttttgatcatggctccgtggaactatccttttttgctgacgtctgcccctctgatcggagccgtggctgccggaaactgctgtatcttaaagccgtccagggacgcatccaacacatccgctctgatccggcacatcgtagaagagacttttcccgcaggctatatcgctgttgtggaaggcggaagagaggagaaccaacagcttctcagccagaagtttgatcatattttctttaccggcagcaagacagtaggaaaaattgtcatggaacatgcggcccgccgtctgacacccgtaaccctggagcttggcggaaagagtccctgtatcgttgacaagacggcagatctttctctggctgccaagaggattgtgttcggaaaattgttaaacagcggccagacttgtgtggcaccggactacatcctcgtacatgcatctgtaaaagaggctttgataaaagaactgatctactggacctgccgtatgctcggaaaggagcctctcttaaacggtgaatacccaaagattatcaatgaaaagcaatatcacaggattatgaagctgatcgaaggagagactgccgccttcggggggtacggctgtgaagaaacactgaaaatagcaccgtccatccttccagaggtatcgtgggattcccccgtcatgcaggaagagatctttggtcctgtgctgcctgtgatttcctaccgaagattttcagatgcggtacggcatatcagacagatggagaagcctctggctctctatctgtttacaagaaataagaaaatggaacaatggactcttaacaatctggctttcggaggcggatgtatcaatgataccgtcatacatctcgccacatcacacctgggattcggaggagtcggtgagagcggcatggggtcctatcacggcgaatatggttttcggacattcagtcacagaaagagtattgtaaagaaatcaacatggatggatcttcccatccggtaccacccataccacgagagaaaaaacaggctgcttcatctgtttttgagatagaaaggacacacagtgatgaaagatatctacggacgcacaattgattacatgaggatttccgtcactgactgttgtaatttaaggtgccggtattgtatgccggaagatattcaatctgtggaacatgcagatattttaagctacgaagaactgttaagcatatgtgagagcgccgcagatctgggcatctgtaagtttaagatcacgggaggagagcctctggtgaggaaaggatgtgttggctttatagaaaggctgaaacagcttcccggagtcaggcaggtcaccctgaccagcaacggcctcctcctaaaaccatatcttgaacggctgaaagaggcagggatcgacggcattaacgtcagcctggacacactggacgagaaaaagtataaagctgttaccgggaaaacaggagtacagacggttttgtcggccgtcagaaaatccgcctgcatgggactgaacaccaaaataaattgtgtgattatgaagggtatcaacgacggggaaatctttgatctgctggatataggcagaaaagatgccgttgatatccgtttcattgagataatgcccatcggctttggaaaacaattcaccggaatggattcggatgagatcatgtctctgctccgtgaaaaatatcccggcatcaaaaaagaagaacaggtcaggggaaacggacctgccagatatttaaaaatccccggtttttgcggagccgtggggttcatcgatgcggtccactgtaaattctgcggaaagtgcaacagaatccggctcacctcagaaggtttcttaaagccttgtctgtattacagccgcggcatacctctgagagaaaaattaagatccggaatatcaagagaagagctttcacaactcatatgccagactgtcctggataagcctgaaggacaccgattttctgagagagacccgaacggtaaagcagacagccggaaaatgtcacagatcggaggataaaaaagacgcttttaaatggcctattgaggtggcctttaaaagcgtcttttagcatatatattatttagttcatagattccaaaattgcatcaaccattgcgtcgatttcctctgactggctgtcgttcagcgcagatttgatcgttatggttggttccaggacagtcatttctttcatacctgacaccaactcgttcatctgtctgccggaagttgccgcccacgttccgttctgcatgaacgctatggtacgtttctgaagattatgtgctttcagatcaagcagcacggtctccatattcgggaaaataccgccgttgtatgtcggagacgcaaataccagatggcttgcgcggaatgcttcggaaacaaccacagacggatgggttacagacacatcgtacatggcaatatttttaagacctttgtcagcaaggcgggaagccagtacattggctgcattttccgtgttgccgtaaatagatgcataagcgatcatgacaccctggtcttccggctcgtaagtgctccatttctgatacttttcaatgaaccactcaaggtcttttctccacaccggaccatggagcggacatatcattccgatttccacattggaagccttctttaacagagcctgtacctgagctccgtattttcctacgatattcgtataatatcttctggcatcatccagccatttgtgctcaaattcaatctcatcggcaaacagatttccgttgatcgccccgaaagttccgaaggcatctgcagaaaataatattttgtccgtcgtatcatatgtgaccataacttccggccaatgtaccataggtgccataaggaatgtgaaagtatgttttccggtacagagggtatcgttttccttcacgatgacagcgtctgtctcgatcttaaagaactgtttgataatgtccgccgtctttgcattgcatacgatctgaacatccggatatcgcatgattacttctttgagcatggcacagtgatcaggttccatgtggttgataatcacataatccagtgtgcgttctccgagcgcatggacaaggttttcaaaaaactgctcgctgacagccttgtccaccgtatcgaaaagcactgtcttttcatctaacagcacataagaattgtaagaaacaccgtttggcaccggaaaaatgttttcaaacagggcgagtctcctgtcgtttcctccgatccaatataagtcgtctgtaatattttttgtacaatacatgttttcatccccttagcttgtttgattattttttgtcaatattatatcaatactagtataatgtcccaaaatgcattttacaagtcaaatataccaactgaaaaagattctacataatttccagcatgtttttattatataaattctttgttagtaaaaattgacacatttccattcctcttttataatggagacggcatagagaaggaaaataaaacaaaaatttatataagaacaggagataagacaatgcagatcagtaaaaaaaatatgatcgcactgatcttcgggacagttgctgtgatcatttgcatggtcattgtagtaatgttttccggcggatttaaaaaggataaagaagactcagcagtaactgagacatcctcggaagagacaacgttggaagataccggatcttccgaagatcatcagacgccggaacgcggcacagaaagcaccaggtccggaaaacagagtacgaccgcaacccacaggagtacggcgacgcgcagacagaagaggactacggccgaacggcagaaaacgacaacagccacacaacaaaagaccgaggcaccaaaacctgccacgacggaacagccggccacaacggaacagcagcaggaacaaactgaagataacgttcaataaggagttatgagagatgaaaggcaaaaaaagacatatttggctctggtttcttccggaaatcctggccgcaggtttttctctgttttcatatagaaggctgcatggaaaacaaaagagggcagtgccggatgtattcttctgtgaggcgctcaaaaggagggacggcattttagttccgggcgccctcgtaaaaaacggtgtcataggcgcacagcttaaggaccgtctggacggggcgctgaggctttaccgggccggtgtctgcaggtttattctgatctcaggaacgaaaaaggaagtaaagttcatgcaaatgtacctgcttttaagaggaattccaaaggaaaatctatatgaagaccgagaaggattcgatacattccgcacaatgaagaatacaagttccgcgtttcgcggaaaatcattttatgtgtgcacgcagaagctgtacgtcccaaggacagattatctggcagaagccgcaggacttaacgcccatgcggttatcgcagatacgatgatctatcaaagcagacacaaagacagagtacgggaatattttgccgcatccaaggcactgctggagggagtggtttatcagtggatcaggcgttagactatagagtgatttacagcagcagaaaaactctggccgtcacagtgactgcggacggacaggtgattatcagagcgcccgaacgatttccaaaaagtgagatccgcagatttatcgaagataaacaagactggatcagacaccacgtgaagctttcagaggagagaaaaagtaatcagaaaaatatccgtatgacggccgaagaacgggaagcctatatacaggaggcgaaaactgtgatcacacggctctgtcggatatatgcaggacagatgggagttgcttacgggaaaataacgatccgtgaacagaagacacgctggggcagcgcaagcagcaaaggaaacttaaattttaactggaagctgatactgatgccgcgaaaagttcttgaatatgtggtggtacatgaacttgcccacttaaaagtcatgaaccattccccggcattttatcaggcagtcgcacagtatatgccggattatgaacagccgaaaacatggctgtcgaaacatggtgcagaatataaagttcagttgatttcataaaggagggaccgtaatgaatgcggtttatgaaaaattacagatatgctatgagagcatgcaggaaaaaacagattttaagccgctgatagccattgtacttggatcaggactcggcgattttgcagaggatattcagatcgagacaaccgtagactataaggatctgccggattttccggtgtccacagtggaaggccataaaggaagatttatctttggttatgtagaaaaggtacccgtggtgatcatgcagggaagagtccattactatgaaggttatgacatgacagatgtggtcctgccaatccgtctgatgaaaatgatgggtgccaaagccctgatccttaccaatgcggcaggaggcgtcaacgacgaatttgacgccggtgatctcatgatgatcactgaccagatttctaccttcgttccttctccgctgatcggaccgaacctggaaaagctgggagaacgtttctgtgatatgacaggcatttataatgacagattccaggacatttttcgcagaatcgccaggacacttgaaatcgatttgaaggaaggcgtctatgtgcagctcagcggaccgaattttgaatctccacaggagatcaaaatgtgcagaatactgggtgcagatgcggtcggcatgagtacggcctgcgaagccgtagccgcaaagcatatgggaatgaagacctgcggtatttcctgcatcaccaatccgggcgcaggcatcacaatgaagccgttaagccatgcagaagttcaggagaccgcagataaagccgctcctgtgtttaaggcattgctcaaagaagggatcataaagatagcggagctgctctgagaaaagcagttccggcaatatattcaaaggagagtctcatgataaggatctataatgccaaaattcttacaatggaaaacggtatgcagccgtttgacggagaaatccaaattgacgggtcccggatttcatatgtcggtgagaaaatctccgctttttccggagcagacgggcagtttgaaagagagattgacgcccggggtggtcttttaatgccgggttttaaaaatgcccacactcattctggcatgacctttttaaggtcccatgcagatgacctgccgctgcttgaatggctgaaccggcaggtttttccatgggaggcaaggctcactcccgacgatatctatcatctctccaagcttgcggttatggaatatctgacaagcgggatgacggccaattttgatatgtacttaacacctgatacgatcgctcaggcatccgaagactgcggattcaggacggtgctttgcggtgccctgaacgatttttcacagtctgtcgaacagttggacgaatggtatcaaaaatataacaaaaaagacagtctgatcagctttcggcttggctttcatgcagagtataccacatccgaggagaaacttcgcgctctaaaagagctggcggatcagtatcatgctccggtttatacccacagttcagagggcctcccggaagtcatttcctgcaaagaacgcaccgggctgacgccgacggcttacatggaccgactgggcctgttcgagaatggaggcgggtgttttcactgtgttcatatggaaccaaaagatctccggattttgaaaaaacggcgggtgtctgtgattacaaatccggcatctaatttgaagctggcaagcggcattgcgccgataaagcagatgatggatatggggatcaatctggccatcgggaccgacggcccagcgagcaacaactgtctggacatgttccgtgaaatgtttttggtcacagggctctccaagtaccgggaaaacgacgcctcggccacagatgcggacgctgtgctcaaaatggctgcgttgggcggcgcagcggcaatgggactctctgactgtgatattctcgcagaagggaagcaggcagacctgatcctgatcgacctgaatcagccaaacatgcggccgctccataatctgacaaagaatttagtttacagcggaagcaaacaaaatgtccggttcactatggttgcggggaagatcctctatgaggatggagaattctttatcggagaagaacctgattacgtttacaggaaagcggaagagatcacgggaagaatttttggatattaaaagaaagagagagcatatgaaatttgtaattcaaagagtcagccatgccgaggtggatgcggaccacaaaacggtcgggagcattgaccggggatttttagtactgatcggtgtcggtcagaacgacacgagagagacagcggataaactgattaaaaaaatggcagggttaagaatatttgacgatgaaaatgggaagacgaatcttgcactgaaggatgtggacggcagtctcctgctcgtctcccagtttaccctctatgcagactgcagaaagggcaaccggccttctttcatcaatgcaggaaaaccggacctggcagaagaattgtatgaatatatcatatcagagtgcagaaaaaaagttccgaaagtcgagaccggaatcttcggtgcggagatggaagtgaggcttacaaacgacggaccgttcacgatcatactggacagtgaggacagctgaatttcagttgtcctttggtatggtttatgctataattcatcagagagaaacagaaaaatacgatagatgaggtaagttcatgaaagatataaaggatatgaaaaggattcttttgaagctgagcggcgaagcactcgcgggagataaaaagactggttttgacgaagccacctgtatggatgtggcaagacaggtcaaggttttagccgaccggggactccagatctccattgtcatcggaggcggtaatttctggagaggacgcacaagcgagaatatggaacggacgaaagcagaccagatcggcatgctggctacggtaatgaactgtatttatgttgcggacgctttccgcaccgcagggcttgagaccgaagtattcaccccatttgtgtgcggctcgtttacagaactgttttccaaagacaaggcggtaaaagccatggaagacggaaagatcgctttttttgcaggcggaaccggacatccgtatttttctaccgatacggcaacagctcttcgcgctgtggagatcgaggcagatgctattctgctcgccaagtctattgacggtgtttacgacagcgatcccgcggtcaaccccgatgcaaagaaatacgatactatcagtttagatgatgtattggatcaaaagcttgcagtcgtggatttgacagctacgatcatgtgtctggaaaacaagatgccccttgcagtgttcgggcttaatgagccggacagcatagccgatttattaaaaggaaaattcaatggtacatatgttaccgtaaaataggaggaagaaaaatgttaaagaaatttgaagataagatgcagaaatcttatgagaacatgacatcagaatttatggcgatacgtgcaggacgcgccaatcctcacgttctggacaaagttaccgtagactattacggagtgcctactccgatccagcaggtgggaaatgtctctgttcccgaagcccgcacgatcctgatccagccgtgggagccgaatctgctaggagagatcgagaaagcgatcatgatgtctgacatcggaatcactcccaacaatgacggaactgcgatccgcttgaatttcccggaactcacggaagaacgcagaaaggatctggcaaaggatatcaaaaaaagaggagagacaacaaaagttgcagtccggaatatccgccgggatgccaacgatgaactgaaaaagatgaacaaagccaatgagctgaacgacgaccagttaaaagaccaggaatctgaagttcaaaagcttacggatgcatatatcaaaaaaattgatgatgcggtggaggcaaagtcaaaagagatcatgacagtataacaataaagaaaagctgcagggctggtttgagtcagccctgttttttcgatgatttgacggaggtgttctatggagtcaatgagagtgccggagcatgttgcgataatcttggacggcaacggcagatgggcaaaaaaaagattccttcccaggaatatggggcatgcacagggcagcaagacggtggagagaatcattgaggatgcatttgacatgggcatcaaatacctgacggtatacgcattttcaaccgaaaactggagacgtccgaaggatgaagtggatgccttgatgaagcttttaagggactacttaaagacatgcatcaaacgggcaaataaaaataatatgcgagtccgcgtcatcggagatgtgaccgggctttcagaggatctcagggaaaagatcgaacagcttgaagaagcatccaagggcaacacaggaatcaattttactatcgccctgaattacggcagccgcgatgaaatgatccgcgccatgaaaaaaatggccggtgatctgctggcaggcactctgaaaaaagaggagatcacagaagatctgtttgcaggatatctggatacaaagggacttcccgagcctgacctgatgatccgcacaagcggagaacagcggctgtcgaatttcatgctctggcagctggcctacacagaattttattttaccgatgtgctctggccggatttcaacaaaaaagaattgaaaaaagctgtggagtactataacggaagagaacggagatttggaggaatatagacttatgtttaaacagagacttatcagcgggattgctttagtggcagttaccgtccttggcctttacctgggcggtatcgtaactttactcttaacggcgatcgttgccctgatcggatacaatgaaatactgaagattttcaaaatagagaaatcatctctggcggtccttggatacacaggaacgattctttactatgccgcattgttttttgacctgggtcagtggtccacatcgatcattattttgtttatgatcttcctgctcggatgttatgtgatccgctttccaaagtatcacatgaaccaggtgatggcttgtttttttggatttgtctatgtgagcgtcatgatttcctatatttatcggctgaggatcgctcagaacggaggcgaatttatcgtgctcctgttcctggccgcatggggcaatgatacactggcttactgcaccggcatgttgattggaaagcacaagatgaccccgaaactgagtccgaaaaagagcatagaaggcctgatcggcggtattattggggcggtgatcttaggagcagcatatggtatctatttaaagacaaggatacggtttaattttaatccaatgatgatgttcgggattatctgtggaatcggtgcggctatatccgtgatcggtgacctggctgcttcagcgatcaaaagagattccaggattaaggatttcggtactctgatcccgggacacggcggtattctagaccggtttgacagcattatattgatcgctccggttatttattatcttacaatgatgatctcaggaggcgcgatgcagtgaagtatatttccatcattggctctaccggttcgatcggaacccagacgctggagcttgtacgtgcaaatgaagaccttgcagtgacgactctggcagccggaagcaatgtggatcttttagaacggcagatacgggaatttcatccgcatacagcagttctctatgacaaacaaagagcagaggaactgcggctgcgtgtaaaggatcttgaagtgaaggtgctttccggaccggaaggcctcatcgaggcggcttctgagccatcctgttcgctggtcgtcactgcagtcgtcgggatgatcggcataaagccgacgatggctgccataagggcaaagaaagatatcgctctcgcaaataaggagacgctggtgaccgcaggccatctgatcatgcccatggcaaaagaatacggagtttcgatttatccggtggacagcgaacactccgcaatttttcagtgccttcagggagaggctgaaagagatgtggattccctgatcatcacggcatccggcggaccatttcgtaccaggacaaaagaagaactcaaaacggtcacattaaaagatgctttaaatcatccaaactggtctatgggcaaaaagatcaccatagattccgcaacgctggtcaataaggggctggaagtgatcgaggcacgctggctctttgacatggattttgaccggatcaaggtggtcgtacagcctcagagcatcattcattctatggtgcagttcaaggacggcggggtaaaggcccagctgggaaccccggatatgaagcttccgatccaatacgccctctactatccggagcgcagatttcttccgggtgatcgtttagattttgctgcattgggaagtatctcttttgaagagccgcctgttgatgttctaaaaggtctttcatatgcatatgatgcaggaaggaccggcggatccatgccggccgtgctgaacgcagccaacgaaaaagcagtggctctgtttttgcaggagaaaatatcttttacagagatttatgatctgattgaagatgcaatgaatgcacatcatgtgatagagaatccatctcttacggaggtactggaaacagaacagtgggtatatgaattcatagaaagcaggtaattacttgaacattattattgcaatcttaatctttggcattattatcatcgtacatgaattgggacatttttcagtcgccaaaaagaacggcatccgtgtggacgaattctgtatagggcttggtccgactctgttcggaaaacaggtgggagaaacttattattctgtaaaactccttcctttcggcggagcctgtatgatgggtgaagacgaagaccggccggaggcggacgcttttggaaataaatctgtctgggccagaatggcagtcatttttgccggaccgtttttcaattttatttttgccctgatccttgcctttattatgatcggtatatcaggagctgacctgcccgatatcgccagagtggagacaaagtctcctgctcaggaagcaggattgaaagccggggaccaggtcttgaagattgatggaaaaaagatctacaataaccgcgaactgtcttattatttccttctggactataaaggcggagaagtgcctatcgtgataaagcgggacggaatagagaaaaacctctctgtgaccccgaagtttaacaaggaagccaaaagatatatgatcggcataggctgggaaccatatcaaaaattaaatcccctcaggaccatagaatatggatttcatgaggtaggatttcaaattcgtgtgacggtaaagagtgtcgtgaaactggctacgggacagctgacgctgaatgatctgtcagggcctgtgggcattgtaaaacaggtaggggatacgtataaccaggcagccacttacggtttcacagtccttctttccacgatgctgagtattgcggtcctgatcagcgcaaacctaggagtcatgaatcttctgccgcttcccgcactggacggaggcagactttgctttctcatcgtggaagcggtcagaagaaagcctgtttccaaaaatgtggaagccaccgtccatacggtcggtctgtttttgctgctggggcttatgatctttgtcatgttccaggatatctataagattatgttgtaaaggagtcttagtatggttacaagaaataatacaaaagtcatccggatcggagataaaaagatcggcgggggcaaccctgtgctgatccagtccatgaccaatacgaagacagaagacgtggagtctaccgtatcacagatattaagccttgagaaagccggatgcgacatcgtaagatgtacggtcccgactcccgaagcggcggacgccctgggcgagatcaaaaaaaggatacacattccgctggtggcagatatacatttcaactataagctcgccatcgcggctatggagaacggcgcggataaaatccgcatcaatccgggcaatatcggaggagaggaccgtatccgggcagtcattgaaaatgccaaagagtacggcgttccgatccgggtaggcgtcaacagcggttcactggaaaaagagctggtggaaaagtatcacggagtgacggccgagggactggtggagagtgccgttgacaaagtccgcatgatcgaggcatttgactatgacaatctggcagtcagcatcaaatcctccgatgttcttatgtgtgccagagcatatgaactggtagcaaagcagatcgactatccgctccatgtcggcattacagagtcaggaaccgtgtacagcgggaatatcaagtccgcagtcggacttggcattatccttcatcaggggctcggagacacgattcgcgtctcactgaccggagatcctgttaatgaaatcgcaagtgccaaactgattttaaagactttggggctcagaagcggcgggatcgaagtggtttcctgtcctacatgcggaaggaccaacattgatctgatcagtcttgccggacaggtagagacgatggccgcagatttcgaacatttgaatatcaaggttgccgtcatgggctgtgtcgtcaacggccccggtgaggcaaaggaagcggatatcgggatcgcaggcggaatcggtgaaggccttctgatgaaaaaaggacaggtcatacggaaagttccggaggaggatcttttaagtactctgcgttatgaattagaacattggggtgaatcagatgcaggctgctaaagagcatacaaaagaattttttcaggtgtttcctgacctgaaagtgtctagagatgtagaagaactgttccggactgtgtgtatccgccaggtcgtattcaagaaatcaaaaaatacacttttcatttcttttacaagcgaccatctgatcccaaggatcgacacctggcggatggaacagcagatcagagagcagctgttttcaaaacgttatgtcaaaatacgttttcaggagtttttccgtctttctgctcagtatgatctggactatttatttgaacactatatgaaaagcttcctctttgagttaaaaggcaaaggggaggttatttttaatgtggtcagaaaaggagactatgccattgacggagatgtcgttacctttatctttgaaaatacttttgtcaacaagagcaagtcagaagagatcaaagagtatttcgagacaacgcttaaagacaaatttggtatggagatcaaggtaggctttgatttttctaagacgacagaccggtctctgaaaaaagaaagccagtataaacttcaaaaagagattgagggaattgtcgaacaggccgatcttctctgtaaagaacaggcagaagagaaaaaggcgagaaaaaagaaaaaagaatccaatttttcctacgatttcaagtttaaaagaaagcctaaattcaaagacgatccgacccttctttacggccgcaactgtgaaggggagctcattgagatcaaggatattttcgatgagatcggcgaagtcgtgatccacggacaggttacaagccttgatacgagagaaattcgaaacgaaaaaacgatcatcatttttcatatcactgactttacggatacaatctcctgtaaaatatttgtcagaaatgaacagctcccggaggttctcagcgatctgaaaaaaggaggcttctaccggattaaggcggtcgccatgtatgataaatttgatcatgagatatctcttggttctgtcgtgggcatcaaagcagtctctgatttcagggagaaacgccaggacacgtccatggataaaagggtggaactccatttacatacggttatgagcgacaacgacagtgttgttcagatcaatgacatcgtaaaacgcgcctacgagtggggacatcctgccgttgccatcacggatcacggcgtgcttcaggcctttccgattgcaaggcacgcctatgaggatttaaggcttccaaaagacgatccgtttaagatcatctatggggtggaggcttactttgtggatgacctgggagatttggcaatccgctccagaggccagtccctccggggagactttgtggtattcgacattgagaccacagggttcaacagccatacagaccgcatcatagaaatcggggccgtaaaggtcatagacggtgagatcacggaaaccttcagtgaattcatcaatccgcagatcccgattccatttaagatcacacagcttactacgattacagatgagatggtcatggacgcagatacgatcgaggccgttctgccaagatttcttgagttctgcggggattctgtcttagtggcccacaatgccgggttcgacaccggatttatccatgaaaatacgaaacgcctggggcttgattttcatcctaccattgtggatacgctcggtctctcaaggagcctgatgacccacctggcaaaatttacactggataatctgtgcaaaaatttaaacatcaaactggagactcaccaccgggcagtggatgacgccacagctacggggaaaatcttcataaaatttgttcagattctggaggaaaaagaaatctttgacctggatcaggtaaacgagtttgtcgcaggctccgaagacttcattaaaaaaggccgcacctatcacggtatcattctcgtcaaaaacaacaccggaagagtcaacttaaaccgtctggtgtcggaatcccacgtccggtactttaaccggcgcccgagaatgcccaaatccctgatcaataagtaccgggaaggactgatcatcggatctgcatgtgaagccggcgaactgtacagcgccatcgtggaccagcggtctgaggaagagatcgcaaagattgttgaattttatgattacctggaaattcagccggagggcaataaccagtttatgatcgaatccgcgcgccatgagaatgtcaattcttttgaagatatcagaaattttaaccggaagatcgtggaactgggtgaaaccttccacaaacctgtggccgctacctgcgatgtgcattttttagatccggatgactccatttaccgggcgattctgatggccggaaagggatttaaagatgcggacagccagccgcctctctacttccggacgacggaggaaatgctccatgaatttgaatatctgggaagcgataaagccagagaagttgtcataacaaatccaaatatgatcaatgaccagattgaaaatatttccccgattcatccggataaatgcccgccggtcatcgagaactcggaccgggatcttcgggatatttgttacaagaaagcacacgatatctacggtccgaatctgccggacatcgtaaccaccagacttgacaaagagctgaattccatcatcggaaacggctatgcggttatgtatatcatcgcacagaagctggtatgggattccctggaccacggttatctggtaggatcaagggggtctgtggggtcgtcttttgcggcgaccatgtccgggatcacggaagtaaatcctctgcccgcccactacatctgtcctgagtgttattatgtggattttgactctcctgaagtaaaaaaatatgccaggatgggtatgtccggatgtgatatgccggatgcggtgtgtccgaaatgcggtgcaaaaatgaacaaagaaggccacgatatcccgttcgagacattcctcggatttaagggggacaaggaacctgatattgaccttaatttttcaggagaatatcaaagtaaggcccacgcatatgtggaagtgatctttggcaaaggaaaggcctaccgtgcaggtacgatcggtacactggcggagaagactgcctatggatatgttctaaaatatctggaggagagagaaatatctaaaagaaaatgtgagatcgaacggctggcgaaagggtgcaccggagttaagagaacgaccggccagcacccaggaggcatcatcgttgtgcctcatgacaaagagatctacgactttactgccgtccagcggccggccaatgacgtaagatcaccgatcatcacaacccattatgagtaccattctatcgattccaacctgttaaagctggatatcctgggacacgatgatccctccatgatccgcaggctggaagatctgaccggcgtcaacgctcagaatatacctctggacgatgaatccgtcatgtctttgtttcacggaacagaggttctgggaattactccggaacagatcggaggcacgaagcttgggtctctcgggataccggaattcggaaccgatttcgttattcagatgcttctggacacaaatcctcagagtttttccgatttggtccgcatttcaggcctgtcccacggtacggacgtctggctcggcaatgcccagaaactgatcgaggagggggatgccacgatttcgacttccatctgtacgagagatgatattatggtctatctgatcaatcagggtctggatgaggccttgtcctttacgatcatggagagcgtccggaagggaaaagggctgaaaccggaacaggaagaggcaatgagggaaaaagatgtgccggaatggtatatctggtcctgtaaacagattaaatacatgttcccgaaagcacatgcagtagcctatgtcatgatggcatggaggatcgcctggtttaaggtttttcacccccttgcctactatgccgcctatttcagtatccgcgccaagtcattttcctatgaagacatgtgcatgggaaaagaaaaactgaacaaccggatgagggagatacaaaacacgccgaagtttgaggtgaaaaatgcagacctggatcttctgcgggaaatgaagattgcagacgagatgtatgcccgtggatttgagttcatgccccttgatatctaccgggcaaaggcaaaggattttcagatcatcgacggaaagatcatgcctccttactccgcgatcgacggcatgggagataaagctgccaaggaagccgcagaggcgtccaagggagaaccttttacttccatggaaaatttccgtgaccggacaaaggcgcctaaatctgtcgtagataagatgaaagaattggggttgatgggagatctggaagaaagcgaccagctcagtttcaatttcttttgataccccgaaataatagaaccgctcatataataatttcatgtctgccagaaggcatcggcagactgcggggagtttttgttttaacaacgccgtaaaaaaatccgggacattagatgtgatcctcaatgctatgaccggatgaaatatgcactattcggaaggtaccgcctttctgaaaaagaaatcataaaggaattaaatcgctggtcaggaagacagtttgaccccttttaacaaaaaaattcatcgaatggatggaaggcagaaaaaagcagaaataagctgctttttctgcctttctctgtctgcggcgatattataagcggattgggaaatactatttgagaaatgttatcgttgacagaaattaaggtgagacatataatagacccataccccctgggggtggtaaggaggcgtattatgaaacaaaaatttgatgtgacaggcatgacatgcagcgcatgcagtgcccatgtagataaaagtgtccgaaaattagatggtgtcgctgaagttaatgtaaatctgctccaaaacaccatgaccgtggagtatgatgagtcagaagtaaacgatgatcagattatccgagctgtcatcgatggaggctacggtgcctttgtccatgataagcaagaggaagcaggcaggaaccgggatattggcgtagacgatgagatcaccggcatgaagagaagactttgggtatctatcctgtttatgataccgctcatgtacatttccatgggacatatggtgaatcttccgcttccattttttctgagcggaacccacaatgcggtttctttcgggctgacccagatgctgctggttctcccggtcatgtacattaaccggaagttttatcaggtgggatttaagaccttatttaagggctctccgaatatggattccctgatcgccatcgggtccggcgccgcctttgtctatggagtatttgccatttaccgcatgggatacggcctcggtgtgcagaatcttcagctggtacatcagtaccacatggatttatattttgaatctgcatcgatgatcctgacactgatcacggtcggaaaatatctggaggccaggtccaaagggaagacttctgaggctatcagcaaactcttagatctggctccgaagaccgccaccgtagaacggggcggggaagagattgagatccctgtggaggagctgaatgagggagatacggtgatagtgcgccccggagccagcattccggttgacggagtcatccttgaaggcatgacttccgtggatgagagcgctctgaccggggaaagcatccctgtggagaaatcctccggagataaagtcatcagcgcatccattaataaagggggatttattaaattcagggctacaaaggtaggggatgatacgacgcttgcccagatcatacagctggtggaagatgcatccggttccaaagccccgatcgcaaagcttgcagataaaattgccggcattttcgttcccgttgttattgtcattgccctggcttccgggatagtatggctcctttccgggcagacatttgagttcgcactgtccacggctattgccgtcctggtcatttcctgcccgtgtgcacttggtcttgccacaccgacggcaatcatggtcggaactggaaaaggcgcggaaaacggcatcctgatcaagtctgcggagagtcttgagacggcacatgagataaaaaccgtcgttttggacaagaccggaactgtcacggaaggacggccacaggtgacggacatcgtaacctccggcggcattgaagaaaaagaactggtcaagcttgccgccagtatggagaaaccttcggagcatcctctggcggatgccattgtcttctatggcgaagagatcaatgccggcttctgtgaggtatccggatttgagtctgtgccaggagaagggatcgagggttccatagaaggtgatagggtatatgccggcaacctcaaaatgatggaacggattggagtttctcttggagacctggaagaaaaaagtactgtttttgcctcacagggcaagacacctcttttctttgcaaaagagggcagactgcttgggctgatctctgtagccgatgtggtaaaaccgaccagcagacaggccattcaggaatttgagaagatggacatcgaagtggtcatgctgaccggagataacaaaaaaacagcagcggcaatccaaaaacagctgggcatcagacgggtgatcgcagaagtgcttccacaggacaaagaggccaagatccgggaaattcaggaggaaggcaagaaagtggccatgatcggggacggcatcaatgatgctccggcccttgccagagccgatgtgggaattgccataggagccggcaccgatattgccatcgaatccgcagatatcgtcctgatgaagagtgatctgctggacggagtggcggcagtccagctcagcaaagcggtgatcaaaaacatcaaagaaaatctcttctgggcctttttctataatgtgatcggaattcccctggccgccgggtgtctgtatccgtttttcggattaaagcttaatcctatgttcggtgccgcagccatgagtttaagttctgtatttgtcgtgagcaatgccctgcgcctgaagtttttccggccagactttataagaaacaaagaaacgccggtaagagtaaatgagccggtccaaagagaggaggaaacaaacatgaaaaagacgatctcgattgaaggaatgatgtgtaagcactgtgtaaaacacgtgacagatgcactcaataagctggacggggtggccgcagaggtcagcctttcaaataaaagcgccgttgtgaacttagaaaaagaggtcagcgacgaatcactgaaacaggcagtagaagatgcaggctatcaagtgaccggtattcagtaaggaggggccatgcaggcagacaagactcagatcacaagacttctgaagaccgccaggggacagatcgacgggatcttaaaaatggtggaagacgaccggtactgtatggatatctccaaccagctcatgtctacggaggccattatacgaaagaccaataaagaaatcttacgggcacatatgaaaggctgcattgccgatgccctggctgaaaacaaaggcgatgaaaaaattgatgaactggtagaactcatcgataagttcgccaaataaaataagtttttcttcattgtcttcagtcggctctggaaaggcctccttccgacaattgaaaaaactatcgttggatcattccatttgtttgatgggtatgaaatacggtgtgccctgtgggtatacattatcattccccaacaggcgtactttaaaattttcttttcctaaatgctctttcatcaaattcatagccaattccatttgtgggcttatccatttatttttagctgaatataaaaagaattctatttcatcaagtttcgttttaattggcaacaaagattacagatataaaaggggtgtttacattgacttaaaaaaacaaatttattataattagataatataaaaaaataaaactatcgactggagaagttaaattgggaagaaagacctgttgtgttactggtcacagggatatgccaggtgaagggattagtagcataaagggctctgcgtaaagaaatgaaccagtgttttctgaatgcctgtacccggatgacagtaatccaggaggaaattgacatcgtaaccgctatatggtcgaggattcagaccgcgtagagtgaaagtggagttgcaggcaattctatacctaatcgcgcggagcgcgtccacccgaagggtataaaatacggtgtgccctgtgggtatacctaatcgcgcggagcgcgtccacccgaagggtataaaatacggtgtgccctgtgggtataccttatcgtgcgaagcacgtccgcccgaagggtatgaaacacaggatgccctgcgggtatgatataataaaacctttaagaatgaatattatgtaaaaatggcgaggcggagtcataggctggaggtcaatgatgaaaaaatggtatgacgaagaatatgaatttgaaattgaggtaacagggtttcttcgcggcgatcacacagagcgatattgccgtaacggagaggaaatcggagataaatatacctgtacatatggttgccctgtaaatgcagacggacaagggatctgttctaaagtaatgacgatactgttccctgttatggaggcagtcagaagcggcggggatttagagaacattggcggcagcggtaagtacagcaaggatatcgtatgcccggacggatgtgtgatgttccgactgacagcgaaaaaacttggaaatgagaatttctttaagggaaagttttttaattagcttttcagattggcaaagcaaagaggtgaagtgtttctgaaatgaatatggaaacaaattctaaaatgcttatgctattgaaaatggtcctgcttatggttgtatccgaaaagtagagattctggtttttccaactccttttttaaaggtgtatattattcttactataatagttgcactgttgatggctttgaccccggctttcgttcatggaacaataaatatgtttatgatgtaaatattcaaattgtaggaggttcactatgcttgataaaataccgaagaggtggaaaaacactttgcgccctatacgcaagggagaactgcattggctttatggtaatcctgggaaaagatgagcgggaaaaatttgaagcaggccgaaatgagtattctgagagcgtccggaaaatctatacccacagggcacaccgtattttatacccttcgggtggacgcgctccgcgcgataaggtatgatgaaacaaaaacttatcacgatgggaaatggctgatatatgaacctgttgacacttcattgtttggggatttcatgcattttttatataaatattgccccggatgcggtggcggtgaaggaaatcagtcgtgtaaaatcgcatggagcatgatggtgtagaatactgcttccaatgcggagcagatggaaaagacaaaaatactggacattcttctgtccggctttaatgacgggcgcaaaaagcccctgttttgtacagcagtaactcttttagacttgcaagagctgcgggaggtacttagacaaattgagaacagatccgatttggaaatgttgacgctcaaagaaaagagtgcttttgccgcgggattactgcaggctgcggcagcaaagaacaatataaacttgaagctacgcaagaagaagtgatgatttgaatactgtaatcattcaataaagcattgagaaaggtagagaaccgaagtgagctcctgcagaaagaaatctatctttagaaggaacagaagagaggtgtctttttgataagggagtatttacatttgaatgtttatgatgcgtttttagaacgaatgcattttctttttgaagagtttggtaatatctatgtctctttttccggaggcaaagacagtggtttgctgctcaatctggttctggattaccggaatcagcattatccggaaagaaccattggtgtatttcatcaggattttgaggcgcaatatacgatgacgacaaagtatgtagaacgcacctttgaacggatcaaggaccaggtggagtcttattgggtttgcctgcccatggcaaccagaaccgcgttaagcagttacgagatgtattggtatccatgggatgacacaaaaaaggatatctggatacgggagatgccccaaaaagaatacgtcatcaatctggaaaataacattatgactacataccgttaccggatgcatcaggaagatttggcaaaacagttcgggcgatggtaccggaacgcccatgacggcggaaaaaccgtatgcctgcttgggatgcgggcagatgaatctttacagcggtatagcggatttctgaataaaaaatacgggtataaagatacctgctggatcagcaagcaatttaaagatgtctggtgtgcctcccctttatatgattggtctaccaatgatgtctggcacgccaactatttatttggttacgagtataaccgcctgtatgatctttattatatggctggcctgaagccctcgcaaatgcgcgtggcctccccgttcaacgactatgcgaaggacgcactgaatctataccgcgtcatagacccggagatttggtgcaagcttgtgggacgtgtacagggggcaaattttgcttccatttatggaaagaccaaagcgatgggctaccggaatatttctttgccggagggatatacgtggaaatcctacacgaagtttttattggaaacgttgccaaaaagactgcggaataactatataaaaaaattcaatacatctatccaattttggcatgagacaggaggcgggttggacgaggaagtgattcaagagcttcaggaaaagggatatcaaataaaacgaaacggcgtctccaattatacattgaacaaaaaatcacgcattgtatttgtgggggaaataccagaccacacggacgatatcaaatccacaaaggatattcccagctggaaacgaatgtgttactgcattttgaaaaatgaccatatctgccgtttcatggggtttgggatgacacggcagcagcagaagcagctggacattatacgccgtaaatacaaaagcatagaggagtttgagtatgaagtacaaaagcccagtttatagtatcattgctgttccgatagagaaggtacggccgaataactataacccgaataaagttgcaccgcctgaaatgaagctgttatatgaaagcattaaagaggacggatatacgatgccagtcgtatgttactactcaaaagcgcaggatttttatctgattgttgatgggttccatcggtaccaggtcatgatggaccacccggatatctatgaaagagaacaggggttgctgccggtttctgtcattgagaaaccgattgacaaacgtatggccagcaccgtgcgccataacagggcacgaggctctcacgatgtggacttgatgagtaacatcgtaaaagaacttcatgaatttgggagatcagacgcatggatttcaaagcatttgggaatggatagagatgaaattttacgtctcaagcagattaccggtcttgccgcattatttaaggatataaagtttggagaggcatggcgtcctgtagaggaagagacggcaaaagataataaagaccccttggcagaaaaataagcgatattttatggaggtataatttgcaatggatcatatgaaaaccaatccacacctgattgaattcgtgtgcttgaatcgtgaattgataaattacctgaaagaagagccgcccgtttatcatgaaagctctaaagcgttttgggatgatgagcatatttctaaaagtatgttagaagctcatttaaacacggaaaacgatggagcatcaagaaggcttagcaccattcaaaattccgtcgaatggattgtcagctattgtaaaaacggtcagggtaaacagcttttggatttggggtgtggacctggtatttattccgaattgttatatgataagggattttcagttacaggaattgatttctccaaacgttccatagaatatgcccaaaatcatgcgaaagaaacatgtcgtaaaatccggtattactatcagaactacctggaaatggattatgaaaacgagtttgatgttattatcctgatttattgtgactttggtgtacttcctccgcaagacagaagtgctttgctgaaaaaaatccagaaagcactgaagaaagatggaattctgatattagatgcatttaacaggccatacttggattcgtttcagccaatacaaagcatacggtacgaaaacggtggattttggtctgcggagccttatgtaattattcaaagaaataagtattttgaagaaaccgctaatacattagagcagtatttgatattaacggatgataattgtgaatgtttcaatatatggaatcaaatttattccaaagaaacattcattgatgaacttagaagcggtggattttcagaaattggtgtttttgatgatgtgacaggagcagattttacaggaaaatcagaaactatctgcggcatttttaaagcagtataatatcatttagttgtgtgctatacaaaaggctttatcagaaataaagaacagctaaagaggattgaatggagtatttatatgaagtatgtatgtgtggttatttcggtagcggatatcaacgccgcaagaaagttttatgaggatctattcgggttagaggtctatcaggattacggaaggaacatcgcttttacctgcggtctggcattacagcaggattttgactggctggtaaacataccaaaagaaaaggtattgaagaaatccaacaatgcagaagtcgtttttgaggaacagaattttgacggtttcctgaataagctgaaagagtacccggacattgaatatctgggagaagtcatcgagcatagctggggacagcgtgtgatccggttctacgacttagacgggcatctcatagaggtcggcgaggatatgaaaatggtgatcaagcgttttctgaataccggaatgtctatggaagaagtgtccgaaagaatggacgtttccatcggggatatggaaaagctgctaaatagctgagcaggaaagaaaataagggtttgttgaggtgaataatatggctttcaaattagtcaatgtcgtgccatgggacagaaatatagatgaatatcggaatatgtttatgctgactgatgataatgcaaatttggtttgcccgtttgagtgaatgaattgaagatataaggaggacaaatggggtttgtatggaagaatcaacgaatatgaaaagatatgttgcgcttttgcgtggtatcaatataagcggaaaaaataaggtgccaatggcagaattaaagaaagtttttgaagaacttgggtttacagaggtaaagacatatctgaacagtggaaatgtgattttttcaagtgagaaaaataatatagggagtcttacaggccagattgaaacaatgataaaaaatcagtttggtttggatattccggttttcgtcacatcaaaagaagatctcaaagacattttgcatcatgcacctgactggtggggaaccgaaaataaggaaatctatgataatttgatttttattatgcctccagctacatttgctgaagtatgggacgagatcggagaaccgagggaagaattagagaagataaaggaatataaggaagcggtattctggtctttcaatcgaaaagattatcaaaagacaaactggtggccaaagacggcaagtgcgggcatcagcggcaaattgacaataagaacggcaaacaccgtcaggaagatagtcggaatgtaattgctttcctaaatcggagtttgaaaagagagggcttgctgtctttgttatcgtttcgctgagtataggatgcgttttgggattagtcgtaaaatcaggtaaagctgacaatgattgcatagattatatatttaccgtctatcatgcttttgacaatgggccaatggaaggtttttggggaatcatgaaaagtgaacgctattatgggaaaagatttaccagcaggtattacctactggcagaaaaagtattattattttaattatctacctgacgggaagcagttcatgttccctgtcctttttatagtgatcttttatctcaaaaaacatttcctctttataaaataagctgcaaccacaagcattcccagcacggaacagattaaaaagaatccattgctggatattgattctgtgatgagaaagaaactgtctttgctgaaaaatatgagatatgcctgactgacaaaggctgccaggctcccgatgccaacggctccggccaacacagtccagaccggatcgctcagatcgaaggccccttttatgatcatttccaaaaaaatcaaagtaaaagcagcgacaataataaagatattattccatattccatcaatcagaatatagctcctggttcttaaataagtgtccgcaagcaaaagcacagacattaagagaatcccgtgcaacaacgcattttcacgcgctttcagctgtttttttgtagacgtatactgactcataaactcattcccctttctcctatgaagtataagtatatgataattcgacaaaatattcaaccacaagaaaatttccatatttgcaattcaaattttttcctgctattatattcaattagataatatacagaaaggaaaatgcctgtgaaacgatggattgtctttctgctgtgccttactgtctgcctgtccgcattatccggatgcggcaccggtaaatattccgacagcagttcaaaaaaactaaatgttgttaccactattttcccttactatgattttgtgcgtcaaattgggaaagataaagtaaaactcaaaatgatcgtcaccgcgggcaaagacagccatacatttgaaccgactccggccgatctgatcagcatacagaaggcagatatttttttctataacggcggagcgatggaatattgggtccaaaaaatacaaaaatcccaggaaaacagcggacaggtttcttatgccttcatggattcggtcaatccagtggaagaagaggtgacagaggggatgagccttcctaaggaagaagaaggggaaacagaatatgacgaacatatttggacatctcctgtgaatgcgcagaaagtcgtgaaaaaaatctgcgccgtcttatcaaaggaagatcccggcaacgcccatttttatgaaaagaatacaatgaattatttgaaaaagctcaaaaaattggaccaggagttcagagaaacagtaaaacacggaaaacgcaagctcatagttttcggagataaattccccatgcgctattttaccgaggaatacggcctctcttacagggcggcattcccgggatgcagcgaggaatcggagcccagctcccggacgctttcctatctgattgacttagtaaagaaagaagaaataccggtcatctatcatatggactttggaagcagtaagatcgcggatgtgatctgtgaagcatccggtgccgaaaatatgacgttttattcctgccacaccgtgacaaaacgtcagtttgaccagggcgtcacatacctggatctgatggagaaaaatgtgaaaaatctggagaaaggactgagagaatgacatccattatttcatgcagtcatgtggatcttggatatgacggacatgtcatcgtaaaagacttaaatatggaaatagaacagggggcttatatttctgtcatcggacaaaatggctccggtaagagcacgtttatcaagacgatgttaggtcttgtgcgccctgtctccgggaaaatccggcgcagtctttctggaaagggcatcggatatctcccccagcagacggaaatgcagaaaaactttcctgcaactgccctggaagtggttctgtcaggttttttaagccgaaaacagcgcaggcctttttatatgagaaaagaaaaatttaccgccatggaacagctaaagaagcttggaatcccggagctttcaaaaacatgctaccgggagctttccggcggccagcagcagagagtcctgctggcaagagccttatgcgcaaccgatcagctgctggtcctggacgagccggtgacaggtctggaccctggtgccgcaaaagaactctatgtcttgctgaaggaactcaacaaaaatgagggcatcgcaattttgatggtttcacacgatttgtccaacgccttaaaggatgcagatgagatccttcacatccggcatgaggattactttttcggcagtgtctcagattaccgcagttctgaacatttccatgaaatgaatggaggtgctgtccatggaactatttaaagaaatggtatcatatccttttattatccgtgcttttatcgtgggaattttgatttccctctgtgcagccctgctcggtgtgagtcttgtgctgaaaaaattttccatgatcggggacggactgtcccatgtgtccttcggagcactttccattgcaatagccttcgggatcgctcctttgaaactctcgattccggtcgttgtcattgcggcattttttctcctgaagcttactgagagcagccggatcagcagcgatgcggccattgctgtcatgtcggcatcggctttggctgccggggtcttggtgacttcctttactaccggtatgaatatggatgtatacagctatatgtttggaagcatcctggccatgagcagagaagatgtacgcctgagtgttttgctgagtgccgcagtccttattttgtttctcttttgttatcataaaatttttgctgtcacctttgatgaaagctttgcgcgggcatcgggagtagatgtttccttttacaattcgcttcttgcgatcctgaccgctgtcacgattgttatcggcatgagaatgatgggggccatgctcatttccagcctggtcatctttccggcgctgacggccatgcagatgtttaaaagcttccggggagtcgtgatctgttccggcttcctctccgtcatatgtttttgtatcggcctgtcggggtcttatctcttttctgcaccggccggtgcaagcatcgtcattgcgaaccttataggatttctcgtatttcgtttgctgagaatggttgtcagacagaatgtttgattttcaaaacattctgtgatagaataatttcattattacaagttaggagaaacatatgaacaaaaagaggaatgtgatgctgacgatcatgagcatcattctgttattagccgggatcttaaaccttttgaccaatgtcactctgatgacaagccgcaatctgatgaagatggccatggagcaggtcaggctgagcggtgcgatcttaaccgtgtaccttgtagtctgcattatcttcgggatgcttgaaatagtgtgcggagtttacggcttaaaagcagccaaacattttgaatttggagaaacctgcttccagcttgccatcgcactggtagccgccgctgtattcatatttatttttaatctctttgtaaatgaatttacggctacaaacctgggaggctttgttttcccgctgctttatctttattccatcagattctgcaaataatttcataagcagtcactaaaaacagatgatcagcagattatctgttttgttcttattccataggaaagttcttcgaacctccctatggaataaaaaagccctgcgggcaagtatgcacacaaatgcgtaaggaaatcatttgactgcgtcaaatcgcatttggcgcacaaagcggaacgagtccctcatgattgagggatttagggagttgaagcggacttgtccgctttgttccataggaaagtgcgttctatgtaagaataaaacactacgaaagaaggagaatacgatgtacattgcagatttacatatccactccagatattccagggctacaagcaaagagtgtgatccggaacatctggatctctgggccagaagaaaagggattcatattgtaggaaccggtgattttactcatcaggcatggagggacgagttacaggaaaaattggtgcctgcggaagaaggcctgtatatcctgaaagatgaattccggataaaagacgggatcgctccggacggccagaatccgcgctttgtcatcaccggagagatcagctctatctataaaaagaacggaaagacaagaaaggtccataatctgatccttcttccgggacttgaagccgcagataaaatttccgcaaagctcgagaccatcggcaacattcattccgacggcaggccgatcctcggtctggacagccgggatctcctggagattcttctggacatttctccggatgcggtactggtgcctgcccatatatggactcctcatttttcactgttcggagccttttcagggtttgatacgatcgaggagtgttttgaagacttaacgcctcatatccatgcgttagagacaggtctgtcctccgatcctcctatgaactggaggctttcggcactggactccttccagctgatctcaaactcagacgcccactctccggcaaaactcggccgggaagccaatctcctgaacattgaactttcctattcggacctcacgagagccatccagaccggacaggggctgtacggaacgatcgagtttttcccggaagaaggaaaatatcactttgacggacaccggaaatgcggtcttgtgctgactccgtcagagacaaaggaatatggcgggatctgtccggtctgcaaaaaaaagatcaccatcggagtccagcaccgggtagagcagctggcggacaggccggaagattatctccggcctgatgcgaagccctttgagagccttgtaccacttccggaagtcattgcggcatctacgggaatgtcagccggcggaaaaaaagtgaatgcccagtttgaaaaaatgctctcggagcttggcccggagttttctattttaagagaagtaccgcttgaggatatccggcacagtgcgggagcctgtgtagaggaaggaatccgacgtttaagacggggagaagtccgtcgcgaccccggatatgacggagaatacggaaaaatccatctcatcgaaaagggcgagatggacatcattaacggccagatgacgttttttgattctctgggaattaccgctgcagccgagcatgagaaaaagaagaaaaaaatcaggcctatgaaaaaagaaccagtcatggatgcagacgtccttaacgtcagagatacagggatcaacgaagaacagcaggaggcggtcgctgctgaaaacaggcctgttgcggtcatcgcaggaccgggaacaggaaaaacgaaaaccctggtagacaaaatagcttatcttgtgaaggagcggaacgtgtctccggctcagattacagctgtcacatttacaaaccaggcggcagcagagatgagagagcggcttgccaagaggcttggaggaaaacgtgctgtcaaagacatgaccatcggaacctttcattctatctgtcttcagctgctgaaacagcagggtgaggacattattcttgccgatgaagcagaactcctcgaagccgccaaagaaacactgacccgtttagattcagacaaaaagccaaaggactttttaaaacagatatccaattttaagaacaatgtacaaatggaagaatgcctgacgaaagaggaggcagtctgttttcaggaaattatgagtgagatgggtcttacagattttgacgacctgctcctgaatgtgctttcacagacagaatcaccggttttacaaaactcacagttttcttatcttctcgtagatgaatttcaggatattaacgacattcaattccgtctggtgctttcctggaaccaaaacggaaaagaattatttgtcatcggagatccggaccagtctatctatggcttccggggttctgattccagatgttttgcacggctgaaagaagaagttccggacctgtatgaaatttatcttaagaaaaactaccggtcaacacctgagatcgtggaatctgctcttcaggtgattagccggaatccgggaaacaaacgctgtctttcggccgtccgtgaacccgggaaaccagtccgtctggtcactgtctcaaatgactggtccgaggccatttttattgcaaaggaaattaacaggctcaccggcggcatggatatgatggatgcccagaattatgccgtaaaaacggaacatcccagaggctttggagaaattgccgtattatacagaacccaccatcaggccagagccatagaaaaatgtctcagacaggagagtattccatgcgtcatcacagggcgggacagttttcttgaggaggacaaggtaaaaggtacgacttcattctttcggtttcttctcgatgaaaaggacacgaaggctctccagatcgcactgagcgcttttcctgactgtggaagcctggaaaaagaattcaaacagcttctaaaaaaggagtcccccggaaagattttaaagctctggatggaaaagaacggtcttttggaagatgaatcccttctctgcctgtacaagatgactctgttttataacgatatggcatcctttttgtctaatcttttgctgggaacagaaggagacttaaaaagaagcggtgaaaaggaatatacgtcggatgccgtcaccctgatgactctccacgggtccaaaggactggaatttccggtcgtgttcatcgccggcgcaaaacagagcagcataccgctggaatcacctgtttatcctgcggataaggaagaggagaggcgtctgttctatgtagggatgaccagggcagaagaagaactgatcctgctcacgagaaaagaatcttctgaatttcttgcggacctgccgcaaaagtatacggcaaaagaaaccgcaggaaaagaacagcctgaggctacccagctgtcgctgtttgatctgtgatttcattcaagattcaagataaaaacaagattccgacacaaacccttgtattctgtaaacgaaagtgttataattatcaataacataaagcttaacttaaagagtggacgtaagtccactcttattgtttgcgcagaaaaggaggcagggcaacttggcaggaaaagcagagattgaacagaaaacagaagaacttgtgacaccgatcatcgatgaaaaccactttgaacttgttgatgtggagtatgtaaaagaaggtgccaactggtatctgcggatttacgcggataaagagggaggcatcagtatcgatgactgtgtgctgatcagccgggcactggaggccaaattggacgccgatgatttcatcaaagacgcatatattctggaagtcagctccccgggactcggaagacctttaaaaaagggaaaagactttcagagaagtatcgggcagtctgtggacattaaattatataaggccatcgacaaacagaaagagtttaccggtattttaaaagaatattcaaaggaaagaataattctctggatcgacggcaccgatcaggaatttgaaacaaaaagtgtggcatccgcccgtttatcattagatttttaaaggaggacaacagaaaaaatgagtgaattaattgatgcattaaaccagttagaaaaagaaaagcatattgataaagacgtcattatggaagcgattgaaaattccctggttgctgcatgcaaaagagactttggaaatgcagacaatgtggtggtcaatatggaccgagagaccggagatattgtcgtatatgcagaaaaagaagtcgtggaaaccgcagacggggaagattttgacccggcgctccagatcagtcttgccaaagcaaaagcaatggaccctaaatatgagctgggtgatatcgtccgcgtggagattactccgaaagattttggaagaattgctgctatgcacgccagaagcgtcattgtacagaagatcaaagaagaagagagaagagttgtttttgaccatttttactgcaaagaaaaagacattgtcacaggcgtggtacagcgctatgtcggcgagaatgtcagcgtcagcttagatgacaagacagatgcactcctgatgaagtccgagcagatcagaggcgaagtattccagcccacggaacggatcaaactttatatcgtagaagtaaaagataccaaccgcggaccccggatcttagtgtcccgtacacatccggatcttgtaaagcgcctttttgaaaaagaggtagccgagatccaggacggcatcgtagagattaagaacatcgtccgcgaagccggttccagaacaaagcttgccgtctggtccaatgatcaaaacgtagatcctgtcggcgcctgcgtcggtatgaacggtgccagagtcaacgcgattgttaatgacttaaagggcgaaaagattgatatcatcaactggaatgaagatccttgtgtctacatcgaaaatgcgctgagtccgtctaaggttgtatctgtatcggtagacatggaagaaaaaagcgctcaggttgtcgttccggattaccagttatcactggctatcggaaaagagggtcagaacgcaaggctcgcggcaaggctgaccggctataaaatcgatatcaagagcgaatctcaggctgaggaggaagaggaactccgcggttacgaagagtacgaatccgaggaaatggcagatgagtccatggcttatgatgatgaaaatgctgtggaggaagaactcctttcagaagaatctgaatatattgacgaataaaatttaggatgtgatcgtatgaacaagaaaattccgatgagaaaatgcattggatgtcaggaatcaaaagcgaaaaaagaccttgtgagaatggtgaagcccaaggatggagatatcttcatcgatcccaccggaaagtccaacggacgcggcgcttatatctgccgttctctctcctgcctgaaaaaagcgagaaagtcaaagggtcttgaccgttcttttaagacgtcgatttccgaggaagtctatgacgcgctggaaaaggagatgatggatcttgactcataaaattctgtctcttctcggattggcagcccgatcgagaaatctggtaagcggagaatttgcggtagaaaaatctgtgaaatccggccatgcatatctggtccttgcggccaaagatgcttccgaaaatacgaaaaagatgtaccagaatatgtgcgaatactatcatgtgccgctgtattttttcagtgacagaagcgaactgggccacgccatcggaaaagaattccgtgcggcggtagctgtagaagatcagggatttgcaaaggccattcgcgggaaactcgaaaatagtaaaattgaataatggaggtgcaatctatggcaaaaactagaatccatgagatagcaaagaaatataaaaaacaaagcaaagaaatcatagaaattttgaaaaaaaataatgtcgaagtaaaaaaccatatgagtacggtagaagattcccagatcgcggtcattgaaaaggctcttggagtaaaaaaggaagaaaaaacgacgaaaaaagagaataaaccagagaaccgccaggaaaagccaaggaatcagcaggggagagaccagcagcgcggcaacagggggcagcagagacctcagaatactcagaatcagaaccgtgccggtaaaaaaccggaaaggcagccgaaggaaaaagaagtgggtcagaatcagggaactcataagaaagtcctgaaaaaagagaatcctcagaattctcagaaattctccaataataataacggacagaatgggaagaataaaaacaataagtttaacaaaaagaacagaaagaacagaaacaacaaattcaataataaaaaccaaaatacacagaagaagaaaaagacaggaccaggtgctttcatcaagccggatccagtaaagaaaccagaatatgatccaaatgagccagtaaagattcctgagctcctcactttaaaggagtttgcggaagcgatccatattcctgcaaacgatatcattaaaaagcttctgatctccggaggcggccttgtgaaccttaacacggaattggattttgagcgtgcagaagagatcgctttagagtatgaccgcattgtggaattagaagaaactgtggatgtcattgaagagctgcttaaggatgatgacgaagaagatacaaaaaatcttgtgaccagacctccggttgtgtgcgttatgggacacgttgaccacggtaaaacatcccttttggatgccatccgttctgcccgtgtcaccgcaggtgaagccggcgggatcacacagcatatcggtgcttataccgtacagacggacaatgggaccatcaccttcctggatacaccgggacatgaggctttcacatccatgcgtatgagaggtgcccagtccaccgatatcgcgatccttgttgtagcagcagatgacggtgtcatgccacagacaattgaagcgatcaatcatgccaaagccgcaggtgttgaaatcatcgtagccatcaacaaaattgataaagaaagcgccaatattgagcgcgtaaaacaggaacttacagaatatgaactgatccctgaggactggggcggaacaacgatcttctgtccggtatccgcacatagcaaagaaggaatcgacgatctcttagacatgatctccctgaccgcggaagtgctggagttaaaagcaaatccaaaccgtaaagcgagaggaatcgtcatcgaggcagagcttgacaaaggacgcggccctgtggcaactgtgctggtacagaagggtaccctccacgttggagatgccattgcggtaggaagcgcccacggaaaagtccgcgccatgatcgatgataagggaaaacgtgtcaaagtggcaggaccgtcaactcctgtggagatccttggattgagtgaagtgccgtttgcaggggaagtctgcatggcaatggaaaatgaaaaagaagccagatccactgcagagaagttcattgcctacggccgtgagaaaatgctctctgagacaaaatcacagctgtcactggatgatctgtttgaccagatccaggcgggaagcgtaaaagatctgaatatcattgtaaaagcggatgttcagggatctgtggaggctgtaaaacagagcctttccaagctttccaatgaggaagtcgcagtcaaggtcatccacggcggagtcggtgccatcacagaatctgacgttatgcttgcatctgcatccaacgccatcatcattggattcaacgtgcgtccggaccctgccgcaaaggatgccgctgagggcgaaaaagtagatctcaggttataccgtgtcatctacaatgccatcgaagatatcgaggcagccatgaagggtatgctggagccggaatatgtagagaaggtcatcggccatgccgaggtacgccagacattcaaagcatccggagttggaactattgcaggttcttatatcctggacggtgtgatccagagaggaagcaccgcaagacttatccgtgacggagtcgtcctccatgagggtgagtttgcatccattaagcgttttaacgacgacgtaaaagaagtcaagaccggatttgaatgcggacttgtacttgaaaattataatgatatcaaggaaggcgatcagattgaagcctatattatggaagagatccctagataagccttcttgacaggaggaaaacaatgagaaagaacagcattaagaatactagaatcaatggggaagtacagcgggagttaagccgcatcatcagccgggagatcaaagatccgcgcatcgcacctatgacttccgtagtggatgccgtggtcacttccgacttaaaacagtgcaaagcctatatcagtgtcctcggtgaccaaaaagcaaaggacgatacactagcaggccttaacagcgctgtcggctatatccgaagagaactggctcattccatcaatctcagaaataccccggaaatcacttttgttttggatgattccattgaatacggagtggaaatgtcaaaaaagattgacgaattgaacaaataggagaagcgatcatgaatgaattcatatcatccatcgaagctgcagattccattgccatcaccggccatatacacccggacggtgactgcattgggagctgtctggggcttcggcagtacattttagataatttccgcgggaaatctgtgactgtttatcttgaatcaccggcaccggaattccggtttctttccggcgccggttctgtcagacacgaggcagaagtggtccgctatgatttgttctttgttttagactgcagttcgctggatcggatcgaaccgtttatctccatgtatgaaaatgcaacaaaaacgttttgtattgatcatcacatcagcagcaaaggcataggacaggaatatatcttaaaaccccaggccagcgccacctgcgaagtgctgtatgaattgtttgaccctgaacacatctcactggactgtgcttactgtctgtatacgggcattgtacatgacaccggtgtattcaaacattccaatacgacaaaacagacgatggagtatgcgggagatctgatctccagggggatcgacacttccaaagtgatcgacgagaccttttaccaaaagacatttacccaaaacagggttcttggacaggctttattaaacagctgtctgtatgaagacggacaggtcatcctttcctatcttacgggcgaagagatgaagcagctggaagctgattccggagataccaacggtatcatcgaccagctcagagtcacaaaaggcgtggaggccgcagtttttttatatgcactggatgctgacacatataaagtcagcatgcgttccaacggaaaggtaaacgtggctgctatctccgaagaatttaagggcggaggacatgtccgtgccgccggcttcagcatgaaagcggatctggctgaagtgaccgataccgttctttcaagaatccaaaaacaattatagaggtgcttatgataaatggtatcttaaatgtatacaaagagcccggctttacctcccacgatgtggtggccaagctcagaggcatcataaaacaaaagaaaataggacacaccggtaccctggatccgcaggccaccggtgtgcttcccgtctgtctgggcaaagcaaccaggctctgcgacatgctcaccgacacaaaaaaagagtaccgggcgtcgttccgcctcggattaaaaacagacaccgaagacatatgggggacggtcaccgaagagtcagaggccgatgtttccgaaaaacaggttgaggacgccgtattctcgtttgtgggagactatgagcaggtgccgcctatgtattctgccctgaaagtgggcggtaaaaagctgtatgagcttgccagagaaggcaaggtgatcgagcggaagacacgccctgtcaccatttttgagatcaacgatttaaggctcgatcttccggacatccacatgactgtggtctgcagcaaaggcacctatatccgcagtctcggacgcgatataggggaaaagcttgaatgcggagcctgcatgactgcactggagcgcacagcagccagcggtttttataaatcaggcagccatacactggaagagatcgaagaactcatgagggaggacaggatcatggaggtggtcattcctccggaccagatattttcagatcttcctgaacgcacagtgaaaaaacagtatgccaagattttgtataatggaaatccgctgaaaaaggattgctttacactgcctgtaagcacagaacagcgtcttaaaatctatgatgaggacggccatttcatcgggatttatgactggaaagaccaaaagagcatgtactttccggataaaatattttactgaaaggagcactatggaatacatacatcaaacggagaactttcaatttcataactctgtggtagcgcttggaaaatttgacggactgcacaaaggacatcagcttatttttgacgagctgctgaaatacaaaaaacagggatatcaaacggttgtcttttcttttgaccgtcccccggtcaataccctgaagtcagaaaactatcatatgatctattccaaagaggaaaaagagcgtttacttgcaaaaaaaggactggatgttctgatcgaacatccttttaccaaagaattctccaagctctccccgagggattttgtcactgaaatactgatcaaaaaggtcggaatgaagattcttgtggtaggggatgactgcggctttggttataaacgacagggcaacgtggagctcttaaaggaaatgcagagagagtatgattttaaactgatcgtgattccaaagcttgaattaaacggcggcattgtctccagcagccgtgtccgcagtctgctcaaagaagccaggattgaagaagccaaccgccttcttacctccccgttcctcgtctacggtcctgttgtaaagggaaaccatatgggcaaggatgttctgggaattcccactgccaatcagatcccgaatcctgaaaagctgcttccgcccaacggagtctatgtttccaggatcaccatcaaggatcaggtctattacgggatcagcaatatcggagtaaaaccgaccattgaaggtaagaaacatatgggcgtggaaacctatatcctggattttgataaaaatatttatcacaaacctatttctgtggagcttctctgctttaagcgtccggaaatgaagtttgattcattggagcgtctgtcaaaacagatgaaggaagatgctgattttgccagagaatgggtaaaaaaagaagggcttatgtagtagaaacggtataaaatacggtatgcccctgggtgtacttttttccaaagatgcggtataatggatgtaacttaaatgaagttactgaaaagaagggagcggttcatatggctacaaaaacgattattacgattgaaagacagtacggaagcggcggacatttgatagggaaaaagcttgcagaggatctgaatattcctttttatgacggggagttattaaaagttgcggcaaaggaaagcggaatctgtgaggagatttttgaaagctttgatgagaagccgaccacgagctttttatattcccttgtcatggacccatattctttaggatataacgccaattcctttgaccttccgctgaaccacaaagtatttctggccgcatttgacaccatcaaggacatagccagcaaaggtccatgtgtttttgtcggaagatgtgccgactatgcactggaggattttgataactgcctgagtatttttatccacgctccttttgaagacaggatcaaacggatcgaagaagtatacgagatcccgaaagccaaaagcaaggaagctcttctaaagaaggataaacagagggccagctattataattactacagctcaaacaaatggggcgatgccaaagcctacgatttttgtatcaacagcagtcttctaggcattgaccagaccgtggatctgctcgaacaggtcatcgcagaaaaagagaagtgatcagaaatattttatgattgctctgtacattttccaatcatttattatctaagaaagtccgtgggatattctcacggactttttttgtctagtgcatcatatattataaaattttgaattatatgtcattttagtataaaaacgcaatacaaatctgattatccgctaaaacacagtatctatcagcattttcaaggaaacaaaaacattaatttactaccaatgaatgagccttgatacgcaagttttctggatatgtaaagatatggtacggcacatcagtattgaaataagaaaaaaattgaatatttcatagactatggaacgcctaaaatgacgttccttttcttcaacagtattttgcatagagaaatgtatgtaggaaatatggtgcaaggcacaaagcaccagcgattgagaaatcaacctatgaaccaaaggcacactacattttatattacttgacaagtaaacgagtgtttactataatggtttacagaagtaaacgttcgtttactaaagaaggaggttgtaaatgtctgacacaaaagaaaatatattaaaaattgcactacacttatttgcagtgaatggttatgaggctgtttctgttagtatgattgcggaagccttgggaatgacaaaaggagcattatataaacattataaaaataagcaagatatttttgactgtatcgtagaacgtatgtatcaaattgataataagcgagctaaggattatcaagtaccagaaagcacaatagaggtaacccctaatgcatacagaaatacaactattgaaagtctaataacatttactcttgcacaatacgatttttgggtgactgatgaatttgcgtctaattttcgcaaaatgttaatactagagcaatatagaaatttaaaaatgaatatgctttatcaaaaatgtcttgtaaatggtcctatcagttatatagaagatatatttaatgaaatgattgaaaaaggtgttcttcaagagtgtgatacaaaacagcttgctattgaatattatgcgccattatttctatggataagtgtagcagatgcagttgaaaattgttgggatttaaaaactcaattaactacacacgttaaacaatttgtcaagaaatatattataaatgagaaagtaaaataatcctttattctgtcctaaatgcaaatataactttttaatttcagcagagaaactcaaaatgaatattgttataagtcacaaatattaactattaaaatattacaataacggagatgagaaaatggaatatattcgcagtaaaaaatattttacacccgacttacagacaaaaattatgggaccgaatcctataaaattacaagaggaactattacaaaatcataaaatcccgtctggtagctttgtctgtgaccttggaagtggacaaggtttaacttctgtatttcttgcaaaagaatatggatttgttgtttttgcagttgacttatggagtgagccaaaagaaaatgaagaatttttcaaaaaaatgggattatcttctgcacaaattaaatctgtaaaagctgacgccaatgaacttaaatttgagaaagagttttttgatgctgtagtaagtacagattcatataattattttggacgtgaccctatatatttagatgaaaaattgcttccatttgttaagaaaggtgggtttgtttatatcacagttcctggcatgaagaaagattgccatgacaaacttccagaagagttattgttatcatggacaccagaagaacttgattatatacatgatataacatattggtctaacataattagtcattgtaaaaaggcagatttaatttcaatatatgaaatggaaagtaattcggaagtttggtcggattggataaagcaaaataatgaatatgcaataaatgaccgtaaagcaatagaagctggcggtggagattatctgaattttattgctataattctacaaaaaagataaattctttagaaccagacactataatttgcgttctaatatgtttatcgattgacatcaataattttatctttgagggtaatgatttgaaaacagaaaatcgctatgtcacagccttggtaggccatcgcgcagcgattttgttcaatcccagtttgtaaaagtcaataaatccaaagataaatttgtatttgaaagcagtgaccatagctacagttcttatgaaccttattgtaacatctggggccatgactataaagtaacttattaaccaatagacagagaatggatgagccagcattatggaagaagaatcttcggaaaggatgtttagaattatccttctgtctaacaaaaaaagaataagtctgtaagctgtttttcttgcttacaaacttattatacgaggagttttgaagaatgaaaaaatatgagtatgtagaaattaactataatgcgaaaggagttgtattcctttgtactgataaacacaaagaaattattgacagttacgcaaaaacggggtatcactacgcagggtttgtacccacagaaattgacgcaaaaggctgtatgcgaaagatagatttaatttttgaaaaagaagattaactttattttagggagttggttctaatgataggattgaaaaacgagatattaaaaaagcattgaaagctggtgcaaaagctggcggtttatcgtatgctgatgtacgagctgatattgaagcaacgattgatgaagctatgaacagcacagatccggaggtgcaggcaaattttaaaaagatcttcgggaataaacgccctataccagaagaatatatttataagattacgaagaaaaaagtttaatttctttaattagttttgtaatagaaaagaactcaacttatcgctttaggtgtttgtcgtagttttgttgccaaaatgacagcggagaatagggacatcaagctgccgtatacaaaaggctcataagccccgattccatcccacagaagcccagcaattacccttgcaggcagcaaggcaatcccggcaagggtggagtgcagccccagcatcgtcccctttaactgcggcggagcaatttccgcgatgaatgcccgttccacacctgctgtcatggcagtaaacacgccataaattacaaaaatcagaaagacaggtttgcacaaggaatcgccaaaagagaagccgtcaggttatagatgaagtaaagcgggatggtattgctgctgtcaaatccgatatctgcggcacggagcagtagaaaactgtttgaagaattattgcaccaaatggtctgcaagctggaaaatcaccatttattgttacaataaaaaagcaaccacaatcttttataaattcatattccttactcatcattgattatgtataatccaatcatatcagcagttcaccttgcggaaagcccggctgaagggctctgtggaactatatccgtatttcattgctaactctgccacagaagcagttccagaaagcaattcttccgcagcaagtgtcatttttctcttggtaatatgctcgttgacactatggtcgaagacataccggaacagcttttgtagagaagaaagagaaacgctggaagctttggcgatattctcttgcgtacaattgtccgaaatatgaagcgtactacacgtcaaaccgcctaaatataggcgtggcaggagaaaatctatgctcctgccgatacatatctatttttatccttatcgagtgtaaatcaagagccagacgcaaagacgcagagccgataatttataggttaatgtaacttgtagattgtcggctcttatttgtttcctgcaaagcacattaacaaataattcttaaagaaacatcgctaaaaggaaaatagggaaaataagaagctgattacttcttattctccctgctgttcaagataccgtcaatcgtaccttgaataatttttaattcgttatcactcaataaatcaagtgatgtttctatctgacggcgagctgtgcttttgccaactttctctggcggatagaaatattcatcaaccgatatattgaacatggtaactaaatcatggaatcaactgaagaaatatttcagtccagtattacaatcattataccctttacaagaatttaaaattcatatcaataacatttacaaagcagtctgtttgtgtacttacattcacacgggctgttttcattttattaaaaagttttttcgattttttctggtttcaacttaacaaatcatacctgccattccctatatggtgcggaaagagggataaacacttttcacgtcataacggaaaggcggtaatgatattcgtatttgtgatgatgaattggcagaagccttgaaaaagctgtccgaacgtaactgtgaaaatttactgatgtactatttcttggacatgagtgacaccgagattgcaaaaaaacagaatattttcagaagtggagtttttcaaaaccgacacaattcatatcaaagtgctgtttgcgtccactctatgatgaatacggtaatgtttatattgttgtagatatggagttaaaaggacttatccgagaagcacttatcaaaatgattttagggtttgatattgccttagaaattgaagaagaataacaagcagtaacgtagagcatgatttgttcaatcccctctttcctgctctgcaccctgcttttacatgaaagcataccgctttcaccggttgtgcttctgttagaaacgggacttcatatttctgaattttgtggattgacaacgcatattgatatgcagaacagaatactcaatatagaccaccagctattaagagatagcgaaatcggctactatattgatactccaaaaacaaagaacggaaaacgagaacttccattggcagaaagagcttatcaagcactccaaagaatactaaagaacaagttaccgaacatcacacctcattcagacatacctattgtacgaatatggaaaacaaaggaatgaaccctaatactctgcaatatctcatgggacacgctaacataaccatgacacttggctattatgcacacggtacatttcaatctgcaaaagcggaactggaaagactggtaagctgggataatttaaaaataagctttctttgaaaatgttaatactcttttcaaaagtaagacaagcagaataaatgatccatgagacgttatcatggatcatttttctatccattcattataatgagactatcaaataatttaaatttatacaaaataatgaagatatcttgattgctttttggtataataaagataattatcaaggaaagatgagagtattattatgatatctgaaaaatctttttataaaacctttgctctgctgacgttatcgctggcattgcaaaatctgctcacctacggcgtcaatctggcggataacctgatgcttggttcctacagtgagacggctctgtccggctcggccctgtgcaaccagattcagttttttttacagatgctggtggtgggtgcctcggaaggggcagtggtcatgggaactcagtatttcggaaaaggcaggtttgagcccatcgtacataccatcgggaccgcagtgcgcttcggcggcggtattgctgcggtcatgtttctgctgattctgttcttcccaggacagatcctgggccttctcaccaatgacgccgctgtcattgcagaaggagtgaagtatctgcagattatttgttttacctacctgatgtttacagtgactaatattttgacggcatccctgagatccgtcgggatcgttaaaataggatatatcatctcagcatctacgctgatcctgaatattatcctgaactcatgcctgatctacggcaattttggatttccggagctgggtatccggggcgcagccgttgcgacgctctgttcacgcacggtggaacttttgatcgtgatctggtatttaaaatacaaggaacattccctgaacctgaccttaaaaaagctggtattcatcgaccggtcgtacatcagagactataaaaggaccgcacttccggtactcacaagccaggcacaatggggccttgcccagatggcgcagaccggggtgctcggccatttaggagccccggccattgcggccaactctattgccaccattgtatttcagatcatcacggtggtggtctacggctctgccagcgcctcagggatcatgatcggatggaccatcggggagggaaaagaaaagaatataaaacctatggtaaaaaccctggagattttattcctgtccatcggcattttatcgggactggccattttcctgatccgtgaaccggtcctgtccctgtatcagatctccccgcaggcaaaggcactttccatgcagtttatggcaatactgtcggtgacaactgttgggaccgcatatcagatgtcctgcgacaacggtattatccgcggaggaggcaacaccagcttcagcatgaaaatgaacctgatcagcatgtggctgatcttgctgccgatttctatctttgccgcctttgtcctgcatctgtccccgatcattgtcttcttcctcctgaaatgggatcagctttataaggcaatccctgtattcataaggctgcaccgctggaagtggatcaccaaggtcacaagggaagaagctgcctagagagaaaggagagaacctgtcatgaaactgatcacctgtctggatgacaaaaacggcctattattccattgcagaaggcagagccaggaccgtgggctcagggcttttatgaaagacatggtaaaaggctccagagtatatatgaactcttacacctatgagctctataaagatatcccaaatgctgtggtctgcgatgatttcttagaaaaggcagacaccggggattactgtctggtggaagactgtccggtaaaggaatatgaagaccgtattgaagaattgatcctattccgctggaataagatctatccggcagacttgtattttgacctggatctgtcggcatggcatctggaagaaacagaggagtttgaaggatccacccatcatatcaccaaaaaaagatatacaaaggagaaacatcactatgaaactgcgaaatagaatctcagccgcactgttgaccctgatcctggcactcagcctcggagcgtgccaggcagctgacaaatccggttcagctgtcaaaatgacggtaaagaccgaaacacagaatgtgtccatagacaatatccccgactattcaggcaaaatgtatgtggagctaaataacaacagccctgatttttcttcaaaggatttaaaatccaaatcctacgagtcctacagtaaactggattctctgggcagatgcggcacagccgaagcaaacatcggaaaagacatcatgcccacaaaaaagcgcggagccatcggaatggtgaaacccacggggtggcataccgttaaatacagcagtgtagacggcaagtatctctataaccgctgccatctgatcggttatcagctcaccggagaaaatgcaaatgaaaagaatctcatcacaggaaccagagccatgaacgtggacggaatgctgccgtttgaagacatggtggccgactacgtaaaggaaaccggaaaccatgttctgtaccgggtcactccggtctatgaaaagaaggatctggtagcaaaaggtgttcagatggaagcgaaatctgtggaggataaaggaaaagcaatagagtttaatgtctttgtatataatgtgcagccaggtatatccattgactacaaaacaggtgagagcacggcatcaaaagcggtatccggccaaaagagaacatcttccgaaaaaagcagtcatgaaagtacctcaagttatatctgcggtaattccaggtccaaagtttatcactgtcctgggcagagagattatgaaaaaatgaaatcctctaagtatcttgtgaagttccagagtgaaaaggaagcacagcaggcaggatacagaaaagcgaaaagataacgatttaaatcagagggaggacaaaagtatgacctcctgcatgaggctatccggaccatggtcctatggtcaaccgttttctgtgtcatctttggtttatccgttgccctgttttccgcatccaccatatcccagtttacaaaggatgaccttgtcatgatcgatgtgggacggaaagcactgaggacaaacggactgtcattttttgtgtttgggtgttatacagtgtattcctccctttacctcgcccttggaaaggcaaaagagggttttatcctgggcacctgcagacaggggatctgttttcttcctatcatcctggcagctgcggtcactgtttttatggctttcagccttcgcagagagttgattgccttttcctgtgcctgatgataaaatggtatcacattttaaatacagattggaggagcatatgacttatgaagaattgctggcttcagccagaacctgtatgggggcctactgcaaggcctgtcctgtgtgcaacggaaaagcctgcggcagccagatccctggaccgggagcaaaaggatcaggggacacagctatccgcaattaccagaaatggcaggagatacgggtaaatatggataccctgtctgaaaaccagccggtgagcaccgcacttgagttatttggacagacattccgttatccgttttttgccggtcccgtaggcgctgtaaatcttcactatggtgataaatacacagatgtgtcctacaatgaggtcctggtctcggcctgtgcacaggcggggattgccgcttttaccggtgacggagtcaatccggaagtgatgacagcagccactcaggccatcaaggcagccggcggcatgggtgtgcccacagtaaaaccatggaatctggagacggtacgggagaagctttctcaggttcacagctgcggtgcctttgcggtggctatggacgtggacgcagccgggcttcctttcttaaaaaatatgacgcctcccgccggaagaaaatcgacggaagaattgacagagatcattaaagaagccggacttcctttcatcgtaaagggtgtcatgacggtcaagggtgcgctaaaagcgaaggaggcgggtgcctcagccatcgttgtgtccaatcacggagggcgtgttctggatcagtgcccggccacggcagaagtgctggaggaaatcgcagaagcgttagacggctctataaagatcctggttgacagcggactgcgttccggagccgatatcttcaaggcactggcattaggggcagacggggtcatcatatgccgtccgtttgtgaccgccgtgtatggaggcggagcagagggtgtccatacatatattgagaaaataggagcagagtttcaggataccatggccatgtgcggtgcaaattctctggaggagatcacaagagatatgatccgctgtctctgatcatttggcttgtcttaaataacgagactcatgtatagccgtcaccagttatatatcgtcttttccgacccaagtatagcatgatcgactgtacttgggtctttttatgttgttgaagcgggcttgtcctgtttgtgctataataattttcagaacgcttgacacggaaaggagtttaaagacattatgaaacctcaatcttattacgatgaactgagcgtgcagcagaccttaaagctaagagaactgatccggacactgcctcctttttcaaaggaatttttccgggcgatcgataccacgacccaggtacggacccggatcgcatatgcgtacgacctgcgggtgtttttccactttctgatggatgaaaacccagtatacaaaaattatacggtactggatttcaaacctgaagatttggataggattgaatcagtggacctggaagaatatatggagtatttaaaaacctatgtgtccgatgacaaacggatgcagaacacagaacggggaattttccgcaaaatgtcctctttgagaacgttttatgcctattattataaacgtcagctgatcaagacaaacccaactctgctggtggatatgccaaggatccatgaaaaggagatcatccgtctggaggcggatgaggttgcctccctgctggactttatcgagagaggcggcgataatttaaccggacagaaacggatgtactatgaaaaaacaaaagaacgggatctggctattataaccctgcttctcggaaccggaatccgtgtttcagagctggtaggactggatatgaacgatgtggattttaagaacaacggacttcacctgattagaaaaggccggaaagaaatgaccgtttatttcggggaggaagtggcagacgcactaattcagtacatcgaaggctcccggagcaaaataatcccccgggaagggcatgagaatgctttgttttactccatgcagaggaaacggatcggggttcaggctgtgcagaaccttgtaaaaaaatatgcaaaacaggtgacgccgctgaaaaagatcactcctcataaacttaggagtacatatggtacagctctctatgaggaaaccgatgatatttacctggtggccgaagtcctggggcataacgatgtgaatactacaagaaaacactattctgccatgtctgacacgaagcggagacaggcggcaaaaaaagtgactttaagagagaaaaactagaaagagagagccatccaaatgtttcagaaaaaagatctttttacaataccgaaccttatgggatactttcgcattctgctggtccctgtgtttatctatctctatatcaacgcgcattctgtgacagacacatacaaggccctggctgttctcattctctcaggtgtcacagacttctttgatggaattgccgcaagaaagcttcaccaggtcacggagcttggcaaggctctggaccctgtggctgacaaactgaccctgggcgcggtgatcttctgcctgatccgcagaatcaatggtttccagtacctgtttctcgtttttattgtcaaagaactgtatatgctcctgggcaacctgaccgccatgaagctcaatggaaaaaagctggacggggcagccttcatcggcaaggcagctaccatgatcacctactggagcatgggattttttctcctgtttcccggaatgccaagggccgtccagatctttctgatgatcctgtgcggaggcatgataactgctacaggactgtactatcttcctgtgtttttcaggcttgccaaaaaaatttgacaaagttccaaacagatttgctggcactttgttgtgggattcaatataatgatggcacagaaaggagcaccgtttgtatgatagaagaaaaattattaaaacttagaaagaaacagggatacagccagcaggaagtagccgattttttatccgttaccaggcagaccatctctaactgggagtgcggagtttcccaaacaaaaggatattaaagaataacctgtgtttacctgcttgcaaagacaagaattttgttgctaagttaagcgatactacataggcgtgttagtatttcttctttgtcgctgtgaaatagcagactacttcatttctgcttgattatcctaaaacttattaggttatggtttgtcaaggacttgttgcataagcaatgctgaatagcactctttacaaaacatagggtgataagtaaattttcaaaagcaggaaagaaatgacgatattgatgtggcgtgatataatgtacacaaagacaaatttgaagttgtctaaataaatcaagataaagccactatgctggtgtacattgaaggtggatataatgaatgatatggaagcagtacagataatacaagactatatacgcacgcattataaagatgataatttttgtatacatgatgtctgttctaagattggatattcgagacgacaagttgatagatttttcaagaggtttctgaaaaaaacattacgagaatatatcaatgcagtttgtttgacagaaagcgcgaacgagttgttaaatacaagaaaaacaattttagaagttgctttgaatagtcattatgaaacacatgagggatttgcacgttcgttttataagagatttcacattatgccctctgtataccgtgacaaaaaaattgcaattccattattcatacaatatccagtcagtcactataatgcgttactcaaacataaggaggagttatttatgaataatgctttgaatttttgtatgattactgccaaagaacgtaacaaaagaaaacttatttatctgccatcgaaaaatgcacaagattatttttcttattgtgaagaagttggctgtgagtgggaagggcttttgaatagtattccagaaaaaattgaacctgccgctttaattgaacttccagaaaaatttgtagaaaaaggtttttcaaggatagcagtaggtattgaagttccgttagaatatgataaggaacttccggaatcatataaaatagtagagcttccagaatgtattatgctatattttcaaggtgaaccatatgaaaatgaagaagatttttgtaaagcaatagaaagcacatatacagctattggaaaatataatcctacgttatatggatacaaatttgcatatgatatagctccaagttttaattttggtgcagatacaagcacaggagcaagattagctgttccagcactatataatgattattcagaatagagaattttggaatataaaatttatgatgtaggtaagagcatgtttgtaataaaaaatattatttttttagttggtatgattagtgttgtcagcctgaccgcatgttcaaaagctgataataatcaattgagcagagtaggaatcgaaaacactgaaataacagttcttgaaatggaaatgcatgcaaattacagtaacgcggacccatttgagaatgaactcctgttttgtgtgtccgaagatatggaaactttagatgcggaagtttcttttcaaatggatggtgaaagtggcattgtagaaatcaaggacagaaatgctgatgagattttatggagcaagatatgggatgaaaacgtcagtgacgacactattataattacgcttgagaatctgcaaaaagagaaagagtacgttgtgcggtttactggagctaaaataaattatgcagttgtaaaagtatcgtttgatagtgatttggttcagaaaaaagcaagaccttcaaaacaaaaattcagtttgtagaagtcaataaatacaaagataaattagaatttgaggtggaagtatggcatcaagcaaagaatatttggagtttattttagggcagttatccgaattagaagaaattacatatcgtgctatgatgggagaatttattatctattatcgtggtaagattgtcggcggtatctatgatgatagattgcttgtcaaaccagtaaaatcagcaattagttatatgtcaacagctccgcatgagttaccctatgagggagcaaaagaaatgttgttggtagacgaagttgataataaggaatttctgataggtttgtttaatgcaatgtatgaggaattaccagtaccaaaactgaaaaagaagaaataaacaaatcccagattataaaactataaacattgtgatgtggaggataatatatgacaccagatgaaatattaaaatactgtcttgaaaatttagagggaacggttttagttaatagttggggggaaagagggatatattataatcctgataatattctaaagcgcggtgtctatattttgacggtaaaagagaaagacggggataatgacaaaagctccagcttgaacagggagaatatataccgcgtgaatttaggagtacgaaaaactacttttatagaaatgtttgattttataccaaaacgccctgcaaagggttgtatagttgatatgaattatgatttttctgcaacaaacaaaattcttccccaccctgtatatgcgtggatggggtggatatgttcactgaatccatcggaaaaaacttttgtggaattgaaaccacttatccaagaagcatatgattatgcaaaagagaaatacaagaaacgtaaagtataacttccagtttatgtggcagataagctcagaatcattctgcaaaagatactacacctactatgttatattttggttcacaaccaacagtagagcaattttatgaaaagaatggctgtcgaaaaagtttgcaatcatatattattaataaaaaaggtaaatcttagcttgagcataatttgccgaaaggagtagaaaactatgaaaatgccagaaaaaattgatataagtatgtttgctccatgcggaatgaattgtaaagtttgttataagcactgttaccacaaaaaaccttgtgctgggtgtttgaatagtgataaagggaaacctgaacattgtcgtaaatgcaaaataaaggactgtgtcaaagccaaagcgttatcctattgttttgaatgtgccaaatatccatgtaagttgattaaaaaccttgaaaaaagctataacaaacggtatcaagcaagtcttatagaaaatagtcgttttgttcaaggacaggatttggagcatttcatggaacagcagaaaataaaatatacttgttctgaatgcggtggaattatttctattcacgatagagaatgtagcgagtgtcaagaaaaaatgaaatagcaaaatcttcagtttatagaattgagaaaattataaaggagaaacgaatatgctggataaaataccaaatgcagaagaaatgactgctttagtcggtaaatcattatatgatatatggaataaactgtgtatcttaattgatgaaaagtatgaaatggaatgcttgtggaacaaaggtggtaaagcgtggacttatgagtataaatatcgtcgaggtggaaaaacgctttgtgcgttgtacgcaagagaaaattgtgtaggatttatgattatcttagggaaagatgaacgattaaaattcgataaagatagaaatagttattcaaaagaagtgcaaaaaatttatgatgagacgaaaacttatcatgacggaaaatggctgatgtttgagccaacagatacagctttgtttgatgattttgttaggctgttgggaataaaaagaaagcccaacaggaagtgataatcttatgctagaatttagaatacaaattggaattttgatatgaatgcgaagtgagaaatgatttatgaatgaagaaatgtttatattacttgtatgggaaataatatcaagaaaagtagagcaaacttttaatgcagaagaggaactgttacacattggttatatcgattctaatttgttatttggtattacagaaggaaaaattatagcaagtgatgaatgtattcttacaaatattacaaaagttgatgggaaaatatttatagaatattcatttgatatatcaatgaatttatataattcaaataacgagtatattttcaatatgttctctgtggtagaaggaagttgcaaatttcctgatgaaaaagaatatgactatagctatttgagtgagcattacgatgagatggataggtgtgaattactatcatatgaaaatatcataagtgaagtaaagataaattattcaaatattgatgtgaacacttaaatgtaaatcccagtttatatgactatagaagataaaaaatataatttgtaaggagatgagactataatgtgcattgaatgctatattgatgaaagtagaattacaccgttgttaaatccgatagaatgtttacaaaatcatacacagtatatctgtgggacttgtggacggtgcatctgtattgaacatgaccctaagcgtggtctgcaaagatggaattttcctttcaagtcactagaaattgcaaaaatgtatttgcgtactgctgattacagtatgaaaaaatcatgtggtatttatgaaatagtaagtgaaaatgggagacgttcctacaaaatttttgcaaataatgaggacttacagttatacctaaaaaagaataaaggtaaaacctgtaaagatacaaagcctatttttgctgttgaagaatataaagaatatgcaaatacacaaatacgaaaattgacttctaacgaaatacagaaatatatgtcagagcgataaagagaaagaagacagtacagaagctgtttcgtatatctctcatctgtgatattaaagaactttctgcgcatggggaagatgaagtacttccagaacaggatatatgatagaataagaatatatttatgtgattggagaattctttatgcagatcaccagcctttctattcacaactttaaatccattaaaaccatgcatttgaccaatatcgaaaatgctctgattctggtgggcaaaaataacgcgggaaaaagctctgtcttagatgccgtgcgggcagccggagggcagtatgagatcacggaagatgatttccactcatcaggacagaatatcgagatcggcatcagcatttccatcacccaggaggatttaaagcttctccactcagaagggatcgtaagccactataagaggtatgagatatgggagaagaatttccgggaacgcctcccatcatttcaggatggcagcctgaccttctctttcatagccaacagaaatggcaggatcctgtatcaggatggattccagaaaaacaatccctatatcccgaaagtttttccaaagatctattacatggacacggagcgggacatctcccagatccaggaagatctgttcatcagccaggaggataaactgctgacccagatgcgctccgattgctgcatgtttgacaggaagaagcagtgcactcactgctttcagtgtatcggtctgatccatcagaaaatgccggaggaattaaacgcattcgagacgtccaagttatttgaatacaagttgtatcacctgaatctggaccattttgtggaaaaggtcaataaaagtttccacaaaaatggaggagtaggcgatgtattttattatatgaactacgacatgaattctctgcttaaggtccgttccatgatctacagcagagaacaccaaggggccaggactgtggaacagcagggaaagggcataaggagcatctatattttgtcgctgctggaagcctatgtggaggaatccgctaaaatcccgtgtatcatcatgatggaggtccctgagatctacctgcatccggagctccagaaggcggcgggagaccttctttacaagctttccgaaaagaatcaggtcatgttcaccacccatgcgccgaacttgatctttaacttcaacagccgccagatcagacagattcttcttgataaggatgcctattccgttgtacgggaaaaaacagatctgggagtcatcctcaatgatctgggctacaccgccgcggacctgatggatgtgaattttgtctttatcgtggaaggaaaacaggacaaaagccgccttcctcttttgctggagcgttattactcagaggtctgtgatgaagacgtacggctaaagcgaatcgctatcataaccacaaacagctgcaccaacatcaagacctatgcaaacttaaaatatatgaaccagatttatctaaaggaccagtttttaatgatccgggacagcgacggaaaagatccggatgtcctgggaaaacagctctgcaggtattacgacgagcggagcatatccgatgtggaccctcttcctaaagttaccaggagaaatgtgctgatcttgaaatactattcctttgaaaactattttctgaatcctgcagttatggtaaaattaaaccttatcaatacagaggaagaattttatgaaacgttgtttcagaagtggcaggaatacctacaccgtcttaagagcggcaggcatttgatggaggtgctcggaagaacgctgacatcccctgatgatgtcaaagctcatatggaggagatcaagatttatctgcggggacataacctgtttgatattttttacggtccctataagaaagaggaacgggaacttttgagacaatatattgaattggcaccaagagaagattttcaggatatccttgctgccattgatgatttcatttactttaagagcaaaagaacaagagattaggaggagatattatgggctgtttcggaaatatattatggtttatctgcggaggttttgtaagcggactgggatggtgccttgcaggatgtctctggtgcattaccattgtgggaatcccggtgggtatccagtgctttaagtttgcatccttaagcttctggccgttcggcaaagaggtccgctatggcggaggtgccggctccatgctgttaaatatcatctggctgatcgtcacaggacttcctatggctgccggttctgccatcatgggggcttttctgtgcatcactgtcatcggcatcccgtttgggcttcagcactttaagatagcaaaattagcattgatgccgtttggggcagagatcatataaatacaggagacaagatgaaggttatacttactgcaatcaacgcaaaatatattcattccaatctggctgtctactgcctgcgggcctatgcaaagccctaccgggaggagattaccatcgcggaatatacgatcaatcagcagacagacgatatcttgatggatctatataaacaaaagccggatctactctgcttttcctgctatatatggaatatagaatatgttgaaagcatcctccgggagatcaaaaagctttttcccgccctgccagtctggctgggcggcccggaggtatcttatgatgcccaagatgtgctgaaacgttttccccaggtcaccggagtaatcaaaggagaaggggaagagacctttttggaactgatggactattatcacggcaaaaaagatgatctttcacagattgacggcatcacctggaggagcggagaaacaatcacagacaatccatggaggccggtgatggaccttagcaaggtcccttttgtatataaccatatggaggactttcagcataggatcatatattatgaatccagccgcggctgcccgttttcctgcagctactgtctttcttccattgataaatgccttcggttcagggatctttccctcgtaaaaaaagagctccaattttttattgaccacaaggttccccaggtaaagtttgttgaccggacttttaactgtaatcgtacacatgctatggctatatggagatatctcaaggaacatgacaacggagtcacgaactttcattttgaagtagcagccgatctgctcaatgaagaagaactgcagctgatctcaggcatgcgtcccggcctgatccagttagagatcggtgttcaatccacaaatcctgagaccatccgtgagatccaccggacaatggattttaagaaggtggcaggaatcgtcaaaaagatcaatgaggggcacaacatccaccagcatctggatctgatcgcagggcttccatatgaggacctgcaaagctttgcttcgtcatttaatgacgtttacaaggtaaggccggaacagcttcagctgggatttttaaaggtgctcaaaggctcccatatggaaaagaaaaagcatgaatatggccttgtattcaaggatacgcctccctatgaggttctgtataccaaatggcttccctatgaggatatgatgactctgaaatccatagagaatatggtggagatctattataacagccggcagtttgccaacacaatggaatatttggagcatgagttctcctcgccctttcacatgtatcagtgtctggggaatttttatgaggacaagggatatcacaagatgaatcattcccggatcgcctcctatgagatactggaggaatttatctgccggtatgcagggaatgagagtcttccgctttaccgggaactgttaacctacgacttatatttaagagaaaatatcaaaaacaggccgtctttttccggggaatacacggtaaacaaagacgagctgtatgatctctatgacaatatacttccaaagaatcgggaactctctgcctatgccaataaaaatctgcggaagatgtcccacatcgaaaagttccagtttgatgttgcgggggacgggagccggaaggaaaccctcctgctctttgactatcaaaaaagagaccctttaaaccgccaggcttatgtggtccggatatggagataagatcttgacaagaaaagaaatgaaaaaacaggccagacagacggtgaaaaggcattacgctctatttcttgccatctgtcttgtttccgcattccttggttccgagttttctgactcgataaaatccatcaaaacatattctacggagttcactcatgcagcagtatccggcacagtggccacttcaaaaggtgttgtggatgtggcagaggatatcgcggcaggggacaccgaatccggcagaaagctttccaaaaagattgagaaagaacatatcgacgcatccaaaaagcagaaccccgcattcggacggagcagaggagtctttgcacagatactcaatggcgtcacctcaggatctctcctggtcacactggcatcgggtatgaattccctgtttggctctcaaaatgttaccctggccattttactggttttctgcctggctgctgttttatccttttggattctcattgtcaataccttcgccgtcatctcccgcagaatgtttctggaagggcgtgtttaccacaaagttccggctcagcatgtgttattcctgcttcgggtaaaaaaatggctccgtgcgtccaagacgatgcttactgtttccatttttcagtttctgtggacttttacggtcattggaggcatcataaaaaagtattcctattatcttgtgccttacatcgtggcagaaaatccgtcgatcaaatcccgggatgcaatccggctgtccagagagatgatgaacggacataagtggcagtgttttttttgaaatgtccttcctgggctggtggctgctggaacttgtgacgcttggattgagtgcagttttttactccaatgcctaccggacggcggctttttgtgaatactatacatacttaagaaataaagcaaaggaaaaaggaatccctaatttagagctactcaatgacaaatatttgtttgagaaagcagacgaacaagcaattcaatctgcatatggagatgtactccagattatagaagcagctagtcaatttaaggaccgccgcacaaagctcagcaggtttttttaagactatcttggcatcgtattgatcaacacagaggccgaaaaagaatatgaacgataccagacagagcagcttcacatccaggccatgaaaaatgcggcggacaaagattcttatcccactaggctgagtatgatgccggaaagcaaaaaacgccgcagaattgagactctgcattatatgcgccgttataccttatggtcattgacgctgcttttctttatcttgtcctttctgggctggatttgggaagtgagcctgcatttaatcgccagcggtgtttttaccaacaggggaatccttcacggtccctggattcccatctacggagccggcggaatcttgatcctgacactgttaaataaactgagacaaaaaccgatcctggaatttatcagtatcgtggctgtctgcggatgtgtggaatattttacttctgtctttctggaaacgatgcatcacgggcaaagatggtgggattacagcggatactttctgaatatccacggcagggtctgcgcggaaggcctgcttgttttcggtattggcgggctggccattgtatacgtcctggcgccgtttcttgacaatatgatacagagacttcagccgaattagagataagtttgtttctggcatctaaattttttgctatgaaaaaggattgatttcacaaattaacagtgttataatatgtgggaaataaaaaagcgttgaagagaagagtaatctgtgaaagtcttccagagagagatgcatttggtgagagcatcttaagtactaaaacagatgaagaccacctccgagcggctgcaaaccagcccggccgacaccgttatcgtcaacgaagtggtctgctttacgatatgaagcaggcaaccaagggtggaaccgcgtgaataacgtcccatggatttttccatggggctttttttattccataggaatgttctccctatggaataaaaaagccctccgggcatgatgcacacgatgtgccaaggaaggctgctttgttcttaattacaatacaagaaaggaaaaatactatgaagattacattaaaagatggatctgttaaagagtacggccagagcatgtctgtcattgatatcgcaaaggatatcagtgaaggacttgcaagagttgcttgtgcaggggagatcaacggggaagtcgtggatttaaggactattgtagaggatgactgcgagctgagtatccttacctttgactcggaagggggaagacacgctttccgccatactgcatcccatattttagcccaggctgtaaaacgcctgtacccggagacaaagcttgccatcgggccgtctatcgacaatggattttactatgacatggagaaggatactccatttacacaggatgatctggagaagattgaagcagaaatgaaaaagattgtaaaagaaaatttggagatcacttgttttacgaaaccaagagaagaagcaatcgcatttatgaaggaacgcaacgagccgtataaggtagaactcatcgaggatcttcctgaggattccgttatcagtttctatcagcagggtgaattcattgacctgtgtgcaggacctcatctgatgacaacaaagcctgtgaaagcgtttaagctcacaagcatcgccggagcctactggcgcggtaatgaaaagaatcagatgctcacccgtatctatggaactgcatttgcaaaaaaagcagatctgaaagattacctgaccatgatggaggaagcgaaaaaacgtgaccacagaaagcttggaaaagaactcggactctttatgatgagagatgaagggccgggattcccattctttttaccaaatggtatggtgcttaagaatactttgctggactactggagagaaatccataacaaagcaggatatgtagagatctccagcccgatcatgctgagcaggcacctgtgggagacatccggacactgggatcactaccaggaaaatatgtatacaacggtcatcgatgaagaagactttgccatcaaacctatgaactgcccaggcggcgttttagtataccagtcagagccacgctcttaccgtgacctgccgcttcgcatgggagaactgggattggtacaccgccacgaaaaatccggacagcttcacggactaatgcgtgtccgctgttttacacaggatgatgcccatatttttatgatgcctgagcagatcaaagatgagatcaaaggtgtcgcagcgctgatcgaccaggtttacagcctgtttggattcaaataccatgtggaattgtccacccggccggaagacagcatgggaagtgatgaagactgggagatggctacagattctttgaggagcgcactggacgatcttggacttgactatgtagtcaatgaaggggatggagcattctacggaccgaagattgatttccatctggaagattccatcggaagaacatggcagtgcggaaccattcagttagacttccagcttcctctgcggtttgacctccattacactggagcagacggagagaagcaccgtccgatcatgatccacagggttgcttttggttccatcgaacggtttatcggtatcctgatcgaacacttcgcaggagcatttccgacctggctggcaccagtgcaggtgaaggtcattccgatctctgacaagcatttagactatggaaacaaagtgctggatgcgttaaaagaagccggcatccgcgctgagattgacaccagggctgaaaagatgggttataagatccgggaggcacagcttcataagatcccatatatgctagttgtgggaggaaaagaagaagaaaaccaggccgtttccgtgagaagccgatttaagggagatgaggggcagatgtccttagatgaattcctttctgcggtcaaaaaggaaattgagacaaaagaaatccgccaggtagaaaaagaagacgaagagaaataaatgaaaacatcccgaatacgttcattgccgtattcgggatgttctttaattactgagtaaatgataaatcggggtaacaggattcgaacctgcgacctcacggcccccagccgtgcgctctaaccaaactgagccataccccgctagagatattttatcgaataatatcgaagagtgcaagcattatttaaatatactcaaattctttcttatgataaaataaatacaatagatacaaagcagaaaggaaccaggatattgtgaaactattattgatcgaagatgatatggaaatcagcgagatgctggaagattttttgagcagagaagcatttgaagtggaaacagcttttgacggtgagatggcctgtcagaagttttttgaaggttcttatgatctggtgctgctggatctgatgatcccgaaactaagcgggatggaagtcatgaaaaaaatcagggaggatagtgttgttccgatcatcattctatcagcaaaggatacggaacttgataagtcactgggacttcttttaggtgcagatgattatattaccaaacccttttctgtgacagaggtattagcaagaattaaggcaaacatacgcaggacaacccagtatttaacctttgcagagcagcctgaatctttgcagcttctgaaagccggagaactcaccatgaatctggatgattacacggtttctaaaaatggaaagaaactggatttaactgcaaaagaatttgaaattcttaagcttcttatggggaatcccaaaaaagtatataccaaggaacagatttattctgctgtatggaaagattactacatgggagatgaaaatgcagtgaacgtccacatcagcagactgaggaataaaatagaaaataatgcccggaaacccaagtatatcataacggtttggggaattggttataagctgggggaaaatctatgacaatgcccatcctttacatattggtagtattaactctgcttttcgctgttttctttacagcagagtactttcgatataaaaaccagacgaaaaatattgcagagcttactagacagctcgacaggattttaacggaggatacagacgaaaaagtaatgtcctttaccggttcggcagagattgcagatttaatctgccagatgaaccgcctgctggaggaccgtcaaaaggtaaaagctgattataaaaaagctgagattgcctccaaaaaaatgctctcgaatgtatctcatgatattaaaactccgctgaccgttatccttggatatcttgaaattatgtcagatcagccgggggaaaataaaacagaattaaagaagattcagagaaaagccacccagttgatggaattgatcaatgaatttttcatattgtcaaaaatagaggccggtgatacggatcttaccatgtcaaaactttcgatcaatgagatcttaagacagaacgttgtggatttctataatatcctcacagcaaaagattttgatgtggaaattgatattcccgaaaaagatgtgtttgtatatggaaatgaagatgccataagccgcatcttatttaatttgatcacaaatgtcatccgctatggatcagatggaagctatcttggggtcagactgagagaagaagaatctacagtttttattgaagtgatggacaaagggaaaggaataaccaaagaaaatttgtcccatgtgtttgacagattgtacacgctggacgattccagaaacaaaaacatgggcggcaacggacttggccttacaatcgcaaaaacacttgcagtgaggatgggcggggacctttctttacagagcattccatacgaaaaaactacatttacgctgcaattaaacaaatttaattattaaaacttcctccgaaagaaattcgtaagatttattcaacagttctgaaaatccaaagctgtatgataaatgaaaaaggaagggagaaccatattatgaaagatgtattgaaaacatctcatcttaccaagaccgttgacggaaaagaaattctttcagatctgaatatgtcggtgcacaaaggtgagatttacggattcctgggaccaaacggtgcaggaaagacaacaaccatgaagcttgtcacaaatctttggaagccaacctcaggagagatcgaactgtttggggataaacttggcccctcatcccatgatcttttaaaacggatggggagtatgatcgagtttcctgtgttttatgaggaactaagcggagaagaaaatttgaagctgcactgcgaatatatgggatactacagtcctgactgtgtgggcagtgcacttgacatgctggatctcacaggtgcagccagacaacatgtgaaaagctattctctgggcatgaaacagcgtcttgggattgccagggcagttcttgccaaaccggaactactgattctcgatgagccatataacgggctggatcctgcagggatgaagaagatcagggatcttttaaaaaccttgtgcgacgaatatggcattacaatccttatatccagtcaccttttatcagaagtggaaaatctggcggatactatcggaattatacatcacggccatatgctcaatgaactgtctatgcaggagatttccgagggaagccttgcatatatcgaacttgtgacctctgatgtgaagcacacctcatatatcctggaggagaaactctcggtttctgattttaaagtaatggatgaaggtgaaattcggatctatgacagttctatttccactggcactttgtccagagtgctctcacaaaacaacgtgaaaatagatgccttgaaaagaaaaaatgattcactggaagattattttttgaaacttacagcacaatcagaaggggagggaaagtcctatgtttaaattaataaagttagaatggcagaagcataaaatcagcaaatatattgctggtgctgcaatcttaatcgcagtattagcaatatttaattttgctatggcatttctggggatcgccgatgattccgcaacaggagtcccggatatggctttgaagcacatggggatctccacaaatgtagaactattgacagatatctcatttttaatctttgccgctgtcatgcatgctacatttattatatctgaatataaaaataaaactatggaactgatgtttacttatccggtaagccggaaaaaaatcatgctctcaaaaatcgcagctgtctggatctttagttttgtatctttggccgctgccaaattgatatgttacgctgttgtccagcttggtatgaatttttatcaaaattcctccttcccgatggatgtatcgcttaccgatccaatgttttatctgacaacgcttttaaaatctgcttccacaatctgtattagttttatcgcactttttatcgggatgacagctaaatcctcaaaggcagccattgtctcctcttttttactgattgttcttatgcagggaaacatcggcggagcctctctgagggagaatatatttataccgtctattctcactgttatttcattgctgtttgccgggatatgtgttcggatggcagagaagaaggacattacatgatcatataattgatagaatcccggagattgaatttctctgggattttatcatattaagaacttattcaatttttccatctaaaaaagcatttaaaatattttgtggagcatcataatagaagctgctgttataatcatcaattttatcactgacaaactctatattatgtcaaaatagaatcagaagaatgcagaagatccagctgtgtgttaaaatgaaaaaagaacataggacagaatcattacaggaggaaatatgggtgaattgagaaatatccccggcgtgggaaagaaaacagaagaggatcttcaaatgctcggatatactaccatacagtcattaaaaggggcagacccggaagaattgtatgaaagggaatgcctgatgaaaggctgccatatcgaccgatgtcagctttatgtatatcgctgtgcggtatattatgcctccacagatgtacatgaaccggaaaaactaaaatggtggaattggaaagaccaggaaagagaggacccaatggaaattaaacttgtagaatacaacgatataaacacatgcattgaatttgtagaaatcgtcaaagaagactttgcaggatatgaaaaagaaggatttaaaaaagctctggagacctgtatcaaacacagagaggccatatcggccatgaacgaagccgggaatatcattggtttattgctttattcaaaggcagactgtgagcttgagttccttgcggtacatcctgaagccagacaaaaaggaacggcaagatccatgatcgagaaaatgaaatctaacttcagaacaggcgatcagatccaggtggtgacatttgcatccggtgatcccaagggaatccctgcaagaaaatgttatcataaatgcggattcaaagatgatgaattactcaccgtgtttgattatccgtgccagaaaatgatcctgacagtacaatgatctgcaggattcctctccatctataatttaaattagtattttgcgtatagatatagagatcgcaatttttctcttctgatggtttttgcaccttctgctttcataaatattgaaccaaaggagccatctaacgatagttttttaccactatttccgtcgcactttagaatgcgctcctacaatatacaatagtggtaaaaactcatgttatctttttcgttcctgtctttcaggccatccttcaagatttccatgaatcatagcccgaaacatatgatctttagatcccggatggtcttcatctagcttttttaaagtctcttttgcatactgcctctttgtgtagccgtccatcggacagggactcttttccaccggaagattcatcttattcttaaatccgattacatctgcttcatccatgtacatcaaaggccgaattactttaagatccatacggtccagatacgtcatcggtgaaaaacagtgaagccgtccttcaaagagcatagacatcaaaaaggtctccaccagatcatccttgtggtgggcataagctactttattgcatcccagttcttttatcttttcgttcagtgcaccctttctcatcttggcacaaagagaacacggattggtttccttcctacgctcaaaaactacatctgcgatttcggtttttacaaccgtatatggaactttcagttcttcacacagtttttctacttgagatatgtcaaagtttccgaatccaagatccacagtgattccgtggatttcaaacttgtttgggtaaaaaatgcgtaaatgtgcaagggcatagagcatggtcagactgtccttgccgccggaaatgccgaccgcaattttgtccccttcctgtatcatttgataatcgtccacggctctgcggacgtagcttaatacttgctgtaacttcataatcgttttcctcagtttattcataaattttcgatttttagtataacatattaaattccgaagcgctactgtcgccgtggtaaacgaaaagcacttttcaaaatggagtacgctgtcagatgaacagaagcaactccttgctcggcttaatgaatacgatgtaaaaagcgcactgatttttcctttacactcaaccttcgataaaaataatgccccggagtaatttctcacgttactccaggacatctccatattccatagcctcataccatttttgtgtcctgcctctcaatacaaggcatccacgatctgaatttacggttcacttttcaaacaaatcagatactgctgttctgctttcgatattcggctggtgccattttcaaaatatccctaaaagcagtcgcaaacttactctggttttcgtatcccacccgatttgcaacctctgctatggtgtactgtgtttgtcgtagaagaacagcagcctgtttcatccgatactctttcatatacgcaccaattggttgtccgtaaattcctctaaacgtatcttttaatgttgctgtattgatgagatactctttagaaagctcctcaatcgtaggacgcacctgcagattggagattaacttcttatgaattactctcacaacttctacctgcggggaagtatactgctcccgctgcttttctttcgatacgtctaccatacacaggaataagagaagttcctggacctttatcttaaaatagggtttctgcaggcagtccggtacagaataaagttccgaaaagatatgttcaatttcatcctttgcccgcataacaaaacaattcccatccgcacagaatttttccttaaaatctaaaatgtcaataccgctctcagaaaggatttccggtggatgttctgctacaaatttcaggtcaattaccacagagattccacgataatgctttaagggaaagctcatctccggggaacagttatccattgcatgaatcgaaagatccccttcaccaagatacaggcaggaaccacttaaaagtgtacttccttcccgcccctcacgacagtgattgatctctaatatatccttatccagattttccttccagtcacagcttgcagcttcaaagtcattataaatgagctgtatgccaggataaacctgataaactgtcatcagccccaggccatctgtacagtccatcttataaaccgtacaatatccatcattatcttttggaataaccgcggataacccttttgcgtttgtaatagggttttcgctcataacatccctttctacaattccactattctttgtttgctctgccagaatctctctggcatctcttattatataaattattcttatttcgtaccgctccaatcagaatgatttacaatccatttagcattatattataacccttccaatagtgcaaacagagaaaacgggctgaagctctctaaaagagtatcagcccgaggtcaattatttactgcaatattcattccctacataaccggagcagctgccgctacagcaggaaccgttcttgcggtctatgtagattttctgaacagcccatatcgcataacctgccacgcctaaaacaatgattccggtaacaattcagcccttaccgctttgctttcgctgtagccggcatcctacgaaactcagaaagcatcatgctgatcgtaatcactacaaggattgcatccgtcagggcaatcgccagccatacgcctaagatacccatgccgccaaccatcggcaggatcacgcagagcggaataaacagaatgatctgacggaacagtaccagccaggtcgctttgtttgcttttcccaaagactggaacagcgtcacagcaatcaggaaacttgcctgcaggatataggtactgaacataattcggaaattagtcgcaccagaagctgttatacccggcgttgtaatgaacatcgaaagtaccttatccgggaacagctccaccgggatataaaataccagagacaatactgtagctgcgatcacgaatactttcgtcaatgtttttacccggtcatattcttttgctccatagttcgtgccagcggcaggctggaagccctggctgataccccacagtggtacaaaggaaaagttccagaaccgcagtgccgcacccaaaagaatctgggaagtctcccctccgtaattggatgccacacgataaatcaccgtctgctgtaccagagtcagaatctgcatcaaaagtgcggatacgccaacagaaagaacctgtggaagcagccctccatcaatacgaatgcgcccgatttttacgtttggacttttctttttgaaataccagagggtaacggcggcctgaataaactgtgacaaaatggtcgcataagctgccgcttctattcccatgccataaggtttcaaaatcgtgataaagatcggatcaaggatcatgttcaaaatggctccgccggcaataatactcatcgcctttttcagctgtccttctccacggatgaccatgttcgcactctggaagaagtttacgaacagtgatccggcaaatacgatacgcagatacttctctgcgtaatttaaaatgttgtcactggctccggccagagtcaaaagctggcgggtaaacaccatacccactactgtataaatgacggacagtaagagaaccattgcaaccaggtttcccataatctttttcatggttccctcatccttctttcctatcgcacgggaaaataccgatgcggaacctacacctaacatagcggcagaacccgcattaatcagtgtgaatggataagagacagatactgctcccatctgggctgctcctaccatctgacctacaaagatggaatccatcatgttatatagtccaacgaccaccataccgagaaccgcaggaatactgagttctatcataagcggccagggacttttcgataaaagttttgttcttgtatcaagtgcttgtttcatcactctattcctcctggtccatgtttattagcaatatctaaccaaccatattaagtatataaaatcagggtttccttgtacgctccatcaagcagaagttgcgctccatacggtaataatttttcctacccggtataaggaaccacaaacaacggtggctcatccctccgctgattattacttatttcaggaaaccgctaataatctgttcttctgcctgctgttctgtcagtccgagggacatcagttttacaatctgctccccggcaatcttaccaatcgcagcttcatggatcaatgccgcatctgtacagtttgcagcaatctccggcactgcccggacactggcctcatccataatgatagcatcgcactccgtatgaccgctgcacggggcattgccattgacacgggatatgaaaagctgttttgaatgttcctttgctacggaacgggaaatgatatgggttcctgccccctccccgtttagggctacttcaaaggtactttttgcgctctggcagccgtgtgtcagtaaccgttccgtgaccacaagtgttgctccggcatcaagatcggcagtggtaagcctctccgttgagtccactcccttaatctgcaccgtttccatttccatgtatccgttttctgcaatatgcacgatagtctgaggattcatgatccgtttccccataccgtctccgctgccataatgtttctcaatatatctcactcttgcacctggagcaagaaagaatctgtgaatgccatcatgctgactggcttttgtgcctccgttatggattccacagcccgctataatcgtcacatcggcattctctccaatgtaaaagttattatatacggcttcggatagtcccgactggctgatgatgactggtatatgtacgctttcgcccctgacttccggctttactctaatatcaatacccgaaccatcttctttagataagatatcaatgtgttccgtagttctacgctccacactctttccattagaacggatattgaaagcccccgtcggaatttcatgcagaccagccacagcctccaacaacttcttttgtatcagatccatttcttatcacttcctttcctgatagaatcggcagccacccacatcggagctgttcaaaagttccggcagcacctcgtcacgttctccctggcgcacgatccggccatcgactactaccagaaccacatcggcaatgttcaaaatgcgctcctgatgggagatgatcagaatagagccgtgcagcttacatttcatattctcaaaaacttgtaccagattttgaaaactccacaggtcaatccctgcctctggttcatcaaaaatagacaacggggctgaccttgccagactggttgcaatttcgatccgcttcagctcgcctcctgacaagctgccatttacctcccggtggatataatccctggcacacaggccaacttcggagaggtactcacacgcttgcgaaacggtcaaatcgtggccgaccgatattcgtatcagatcaagcacggtaatacctttgaagcggaccggctgctgaaaagcaaagctgatccctttctgcgccctctcagtaatttccatatgtgtgatgtcctcaccatttaacaaaatttgtccggatgtaggctgttcgattccggcaatcatctttgccagggtggactttccgccaccattagggccggttaccgctataaagcagtcgtctggcagtaataaattgatttgttgtaaaatctcttttgaaccggaatccccggaaacctcaaaagagatatttttcagttccagcatatttcctccatagaaagggcggtacagcctaattgtgaattgcaccgccctgaaaatcattgattcattttctccaaaagctgaagcgcttcctccagctttggattttcaacatccgtctgcagggcctccctgacacagtttctgatatgagcctgtaaaatctgttgattggcacttcgcagtaaagcctgtgttgcctggagctgattggatatatccacacaataccgatcagattcaatcatctgcaggataccgtcaatctgccctctggcaatcttcagtttatgggtaatgtcgctcttttttgctttcataggcagcccgctcactgaatgcttacaacctgataacccgcatcttcaacagcggctttcagtacatcatccggtacatcctggctcatctgtacctgggcggacttgctctccagatgaactgccacatctttgatgccatggatttcccgcaatgccttatctacgtgctttacacagttcatacaaaccataccttcaatattcaatactttttccatttggatcgctcctttgctttcactttttattgttgtccgttcatacacgcggtcctcatttggttccgcatgggatgtgtgttttgctttaaaccatctaagcctcagcgcatttgatactacaaacacggaactgaaactcatggcaaatgccccgatcattggattcaatttcaaatcaaacggcagaaagaacagccctgccgccactggaataccgatgatattataaataaacgcccagaacaggttttgcttaatattacggatgactgccttactgagctggatcgccgttgacacatccagcaggtcacttttcatcagaacaatgtccgctgactcaatcgccacatccgttccggctccgatggcaatgcctacatctgccctggcaagcgccggggcatcgttaattccatcgcctaccatcgccacttttttaccgctatcctgcaaacgccggatttccttttccttatcctgtggaaatacctcggctactacacggtccacgccaacctgacgccggatcgcttctgctgttttcgcattatctccggtcagcatgaccacctcaatgcccatcgcagacaattcctgtactgcctgacggctggtaggctttaccacatcagctacggcaatcacaccaatgagttgcccgccacgggcaaagaacagcggtgttttaccgtcaactgccatagattccccaagctgcaggagtgctccgcccgaaatgccatttgcctggagtaacctccggtttccggcatagcagatatcgtttccgatctttcctacaataccctggccgggaatctgtttaaaatcacttacctgaaggaaagaaatcctttctttttctgcttctgccacaattgcgtctgccaatggatgttcggacagtttttccagggaagccgctatctgcagcagttccttctgacctacaccgtctccacataataagtttgtgactaccggagttccctgtgtgatcgttccggtcttgtcaagaactaccgtatcaataccatgtgctgtttcaagagcttccgcagacttaatcaggatgccgtttgttgcaccctttccggttccgaccatgattgcggtaggtgtggcaagccccaacgcacaggggcaggaaatcactaagatggaaataccaatggaaagggcaaattcaaacccgtaacccaacaacagccatacgacaacggcaatcaatgcaatgctgattaccactggtacaaacacaccgctgactttatcggccatctttgcaatcggcgctttagagctggtcgcttcatccaccagacggacaatctgtgacaatgtggtatcgtcacccactttggtcgcctgcatcttaaaatagccggacttatttatggttgccccaatgaccttatctccgatatgcttctctaccggaatactttcacctgtcaaggcagactcatccacagaagaaaatccttcaatgacaattccatctactggtacagactctcccgctttcacgatcagcgtttccccggcctgcactttctccaccggaacggtaaactcctgtccatcacgttctacggttgcagtcttgggggccaggttcatcagcttggtaatcgcatctgaggttttcccttttgcacgggcttccagagttttccctaaagtaatcagcgtcaggatcatgcctgcggattcaaagtacagatccatcataaaactatggacggtaaccatatccccatatccgaacccgatgcctattttataaatggcataaatcccgtaaacaatcgccgcaccggagcctatggcaatcagggagtccatgttgggagaaccgtgaaacagcgtcttaaatcccatccggtaatatttcgaattgacaaataccaccgggatcagaagcagaaactgtgtaaaagcaaagctcatggcattttccattcctaaaaggaagcctggaagcggccagcccatcatgtgtcccattgatatgtaaaacagcggtatagtaaaaatggcagacagcaggagccgctgtttcatctgcttatattctgcctgtgccgtactggtttccggattttgagtccggcctgcggcactgcttttgttctggacctttgcagccgttttggggaatgccccatatccggctttttcaacagcctggacaatccctgctgtatccagaacagattcatcataagaagcaaccatgctgttctttaacagattgacggacacttctttgatgccgggcagttttcccacactcttttcaatcctggccgagcaggccgagcaggtcatacccgtaatgtcaaattgctccttttgcaatttcatcccttctttctttttatttttatcagggacactcctgtgtccctgctgcagcgtgcatatcagctttgctgataatgtgcacctatgcacgcctgcaatctgccggaggcatatgtcagtgtccactgacatatactacccgtcccccgtagggaacacaatcattataaacacgccttcctggttttgtacgctccataaaggagcatttttgatccaaaaagcaattccttttttgcagaaaatccaatcagcaggttttccaatccaaagggcagaactgctcccaaaaccgttgactttgtgccttttcgtgaatatactgacggcatgaacgattaaacattcttttaattgttcagccatgtcaaaccaaccaaataactatagaaaggggatatcatcctatgaagaaaacaatcaaattaatcgaccttgactgcggacactgcgcagcaaagatcgaaagtgccgtgaaaaagattgacggtgttacgaatgtatccgtgaactttttgaaccagaagatggtactggaggcaccggatgacaagttcgcctccatcctgaccgaagcaaaggcactgatcaagaaaatcgagccggatgtaactgtcaaggtgtgatgaaaagctggacaccggctgccgtttcctggtagccggtgttttttatttcataggaaagttctacgaccttccctatgaaataaaaacgctccgcgggttgtgcacagatgcgtaaggaaattatttgcctgcggcaaattgcatcaggcacgcaaagttgtcaagcccctcaaagagtgagggaggggttggggcgttgaagtgggcttgcccactttgttccattaagacacagggaaagtacaattaccgctttccctgccatgaaaggagaatagaaattatgacacgaaaacaaaagcatctgcttacacgcatcattgtggcggcagtgctgttctttgcagggagcttcttacagcttcctgaatacgtagaaatgggtgtattccttgtctgctacgctgttgttggatgggatattgtatggaaagcgatcacaaacatcctccacgggcaggtatttgatgaaaactttctgatgacgatagccaccgttggcgcattaattttaggggaacattccgaaggtgttgccgttatgctgttttatcaggtaggcgaatggttccagtcttatgcggtttccaaatcccgcaaatccatcgcaggcctgatggatatccgcccggactatgccaacgtagaacgggacggaaaactggtgcaggttgatccagatgaagtgcagatcggagatgtcatcgtagtaaagccgggagaacgcatccctttggacggaacaatcctcaaaggttcctctgcactggatacttctgcccttaccggggaatccatgccccgtgaagtagagccgggaatggaagtcatcagcggatgtatcaaccagactggtattttgaccatccagaccacaaaggaatttggagagtctacggttgcaaaaatccttgatctggtggaaaacgcaagcgacaaaaaaggccggacagaaaactttatcacacgctttgcccgatactacacccctgctgtggtattcgcagccctcgcacttgccatcctgccaccactgatcaccgggcagtcatttggaacctggatttaccgtgctttgaccttcctggttatctcctgtccctgtgcgctcgtcatctccatcccgcttagtttctttggaggtatcggcggtgcgtccaggatcggtgttcttgtaaagggcagcaactatttggaatcacttgctcatacggaaatggtagtctttgataaaacaggtactctgaccaaaggttcctttgccgtcagtgaggtcaatccaaaaggtatgaaagacacacagcttctggaactggccgcatatgcggaggattattctaatcacccaatctcgctctcgatcaagaaagcctatggcagaaaaattgacagcggccgcatcacagaggttcaggaaagcgcaggccatggcgtgcgggctgtcattgacggtaaagcagttctggccggaaacgccaagctgatggtaaaggaacgtatccaatacaccccttctactgctgtcggcaccgttgtttatctggcctgtgacggaaaatatgccggatgtattgtcatagaagatgagatcaaagcagatgctccagcagcaatcaaacgtctgaaatccgccggaatccacaaaacagtcatgctgaccggagatgcagatgccgttggaaaaaaggtagcaaaccgtcttgaattagatcaggcatacactgaactgctccctgccgataaggttgaccgtgtagaagaactgctgaaacaaaaaagtgaaaaaggaaaacttgtctttgtcggggacggcatcaacgatgctcccgtactggcacgggccgatgtaggtatcgctatgggcggtctgggttccgatgcagccattgaagctgctgacgttgtattgatgacggatgaaccatccaaaatcgcttctgtgatgaagattgccagaaagacgatccgtatcgcaaatcagaacatcgtatttgccttgggtgtgaaattcctggtactcatcttaggtgctttgggatacgccaatatgtgggcggccgtatttgccgatgtcggtgtctccgtcattgccatcctaaacgcaatccgtgccatgcgggtaaagcggctggatgtgccttcccagatctaaaaagatttgagaaccgaaatgcgccgcacttcacctaacatgaaagcggcgcatttcccttattcgtcctgtaatcatgacatcatggtatacccggagggtatttcctctattgatttgtcgggcaggatatttcaaataacgcatcaatagaacgatgcaataatttagcctgttgtgtgtctgacaaggagtaatacacttcttttccttccctgcggctggatatgatcccactttttttcagtatccgcaaatggtgcgatactgcgggagcactcatatccacagccgccgcaatgttacagacacattcttcacagtgacagagcagccacaaaatccgcagacgtgtcggatcatcaagctgctgaaataaaaatgctatattagtaaagcctttcacagaaggcatcttgtctaatacccgttcaatattctgtccgtggttgtgaggtagattataatgtgacatcaaaaatgatctccttcctggaactatcatagctatttaaattttatctgtcaaacagcttacacatagattggagaaattacatgaatacaacggaacatacaacttttatggttccaaaaccagaggaattgcagcagctatctgaactttataaagcaatgggtgattatacccgtatgcggatactgtggcgtctgatggagaaagaatactgtgtcagtgatctggcaaaggaaatgcaggccacaaaatcagccatctcccatcagcttcgtgcgctgcggattgtacgcctggtctactcccgcaaggttggtaaaaacgtattttattccttgcaggacgaacacatcggctggatactggaagaaacctacgcacatatttcagagcgataaaagcacagcccctgtgcttgttttacaggggctgtgccaagtattcatttacagattttcataggaaaccaactggctcatcggaatacgctgtgtatcaaaacgattcgtatctgccggatcatcatcagaataaccaattaccagaatgttgaccggttccagactatccggaaggttaaattcctcgcgcagtacatccggcttgaagtaacaaacccatacggttccaagacctaactctgtggcctgcagcatcatgtggtcagtcaggatggatgcgtcaatgtcaccactttgtttctgatcgaatggacgtacccatgccttgttatgatctgcacaaacaatgatcgccaacggtgcattatagataccaacggccttactgaccttcgccagaccctcctcactctgaacagcaatcagatgaaccggctgaaggttagcggctgtcggagccacatgagctgcttccagaatctgctccaacttttccggctccactttctgatttttgtagctgcgtacagaatgacgctgttttgcaatattgataaaatccataataattacccctttctgtgtatcatgtattcggtatgtcaaaccaaccatgaatttattgtagcatgaaatgtaatatccacaagaatgcacttttttgataggtactttcaaaaaaggtagcacccttgcagaaaaggagacgcaacatgaactgtaaacaaactcaatttaactgcccggttgaagccgcactgtctttaatcagcggcaaatacaaacctttaatcctctggcacctgatagaccagtctctccactacatggaactgcagcggctcatcccaaaggcaacccccaaaatgctctccggtcagctccatgatttagagaattgcggaatggttcatcgagaggtcatcccggagaaaccaccaaaaacgatctactcccttaccgaatttggtcgcagtgttattccgatattggacgctttatgccagtgggggaaaggctatctggatggactggatgtgcagtctccgtgctgcaaaggataaaagaaagagccgggtatagctgataaacattggcttttaaatacttcttcaatcacttttattccataagtatcaagttccacttcatctgaaactggcaaataatgataacttgtaccttcatctcgtacagcactagttgggataatcagatgtgcatcatcaatagttcgatccaataccccacattcaccacatacaaaagtttttttctatctattatttctatataaaatcaggccttccatatgtaatgtcccatcaacccaatgaccgcaatcctgctcggtacgcttccatgtctttctcatccaccgtatcaatcacatgctgtagttccccaaggattttttcacgcttttttggcaggtatgccgtagtcggataaaaattcgatttcgaatccgcaaacaaatgtattcttaactgcaaagtgctgataaaaatctgtagttcccgcagtctgtccttctccgttgacggaaggaaagttccttcctgatacctttgatataattctgtttccgggaaaagcgtcagggaatccacagaaataaaataaggatttaactggctgaacagcttcgcactgtttaccgcattgcggtactccccacctcttcccgacagtcctgtcatatacacaaaataatattcaatcccggcttcatccagcttccggcactgttccagtatatcctgagaagtgtagccctttcttgccagagtaagcgtttcatcatctccgctttctgtcccaatcgtcagcccattgattcccatagcccgcagtttcttaagctgccagacctctttattttttatatcccgaatactggcaaacatggcaatcgtctgacatttgatcagataatcccggactgtcagcgcccggagtttcagattctcataactcatagcaaatggattcgcgccagtcagaaaaactctccttgcgtttggctgataatgtttcagctcggcaagatcctcctcaaattcctccattggagacatccgaaatggttcatctttatacaaactacagaagctgcaattacgataggtacagcctgatgttgcctgtaagataaacgagcttgcctcgtaaggcggtctccatgtgcgccctgtaaaatgcataaatgtccctcctttttatacagctctgcgatttgcgctgcagaaaatgattgtctttccagcacagcaaatcgctttgctgacacttcatcctgtattacaggtgacgaagattctcacgatatttccgaaggtatgcttcatcctgactgctgatctgctgctccaaaaaccgaaccagcttcttcttgtcctttttcagattaccgcgcacctgaatcagattagaggctccatctgtagcaaactttgcatccactgtcagattttcaataagtgtctttaattcctccagcttctcaagctccgtctcttccttccaatttcccgcctgaatttctttgtacagctcagaagtcggataaatcgtaagcatggacgcatcaataatcttcggatggagctggtttatgacttttgcagtctcctttgcaccgatattccctctgccggaaccggaaatgccggtcagatagaaaaagttatagctgattcctgcttcgtccatcttcctgcactgttcgagaatatcctttgccagataaccctttttcataaaggtcagcgcttcatcatcaccggtctcaatcccgaaggtaatcccatcatatccaagggcacgcagttcctttaaatcctccaccgattttctggtaacatccgtaattcttgaaaagcagcccatactctggcaggccggaaaatattcatgtacgctctttgccagtgttttcagcttatctacactcaatgcaaagggatttgctcccgtaaagaataccctcggcaccttattataataccggcttgtttcttttaaatcctcctctacttcttcccgcggcgacattctaaacttaaagggcaaatcctcataaagagtacagaatttgcaggagtgatgggtacatcctgccgttacctgaatcaaaagtgagtaagcctcataaggcggtctccaaattgttcctgtaaaatgcataaatcatttctcctttcctgcgcttgtgttgttcatcaattctttgtgcagcacattagctttatctgtatgttcccacggaaggtcaagatcatttcttccgaaatgtccgtaagcagcagtagccttatagattggttttctaagatcaagtgcttctatgattgcagaaggccggagatcaaaatatttttcaaccaaagccagaatctgctcatccggcagcaccccggttccaaaggtatcaataaaaatggaaacaggtgttgccactccgattgcgtaggcaatttgaatttcacatcgatgggcaatccccgccgccactatattctttgcaacatagcgtgcagcataggcagcactgcggtctaccttcgttggatcttttcctgaaaaagcacctcctccatgacgagcaaatcctccataggtgtctacaataatcttacggccagttaaaccggtatcaccctgtggaccgcctatcacaaaccggccagttggattgatataatagcgggtatcctcatccaataactctttcggaatgaccggcatgataacctttttaatcatatcctcttcaattacctcatgcgaaatttcctgcagatgttgtgtagaaagaatcacggtatcaatccgcaccggcctgtcgcctttgtattccacggaaacctgcgcttttccatccggccctaaataagaaagacttccatttttgcggacttctgctaatctgtgggtaatccgatgtgcaagatagacaggcattggcatataggtgtctgtttcatccgtggcatatccaaaaaccatcccctgatctccggccccaatatcagccgtatcagaaaaacgagtctctaatgcattgtttactccctgggcaatgtccggggattgactgtgcagagcggagactacagcaattccgtccgcattgaacccaaaatcatttccggtatatccaatactccggacagtatcccgaacaatttgttctacatcaatcttgtgcagcgcatgagctgatacttcacccattagaacaactaacccagtagtggctgatatctcacaggccacatgagccttcggttctttctgtaaaatggcatcaaggactgcatcggaaatttgatcgcatactttgtcgggatgtccttccgttacagattcagaagtaaaaagtgtttttctcatgtttatcatctcctttgccacaagagtacaggagcagacagatttattcaagtacgcaatttttttagtagtagtagtattttttgtactaatactaaaaaaagattgtgctttaaaatatccttccgttgttatatactctctataaaggcaaacgtgaaaggaaggaatcagacatgacaggaaataaatttcaaacagaagaaatgatgaccagatgtgttcccatgagctgcatacaggctattctaggtggaaaatggaaaatcataatcttatggtatatagcgttttataaggttcagagatttggcgagttaatgcgccggctggatggaattacgcagtcctctttaaccaagcaacttcgggaattagaaagcgatggttttctgcaccggaagatctataaagagataccaccaaaggtagagtattctttaaccgaattagggcagagttttatccctatcttaaatcaaatgatgatatggagcgagcaacatctctgcccgcctgattatgtgaatccttatgggaataaaaatttgtaatccggtactgcgtcttatcacttcttgccccaatctttttcgtataccttatcgtgcgaagcacgtccacccgaagggtatgaaatacagtgtgccctgcgggtatacttcattttccatgcttcgtaccctttcccgtagaacaattatctaagtgtaaattgtaactttatcctttagtgcagcatctgcatcattaattacagactgaactgttcttaatgcatcctgactttgaaatttcttatctttcttacttttaatataatcacccattataaatccttttcattagcttcaaagtaatgacattcaatatccaatcctaaaataatccagataagatttatatctatcctgtgctgtcagacatgtatctgtcaaataacctttttcatcgttccattctttcagtccacgataataaaacatcttcaaattatcttcgatgataaacggaacgatattatatttcaggcattccttaaacataatcaatctgccgacacgtccgttgccgtcttgaaatggatgaattctttcaaatttaacatggaattccagaacatcctccaaagtcttttttcccttggcgttgtactctgtaagcagcactttcattctatcggcaacttcttccggaagtgcagtatccatgccaccgacttcgtttggcatctttttataatcgcctacagaaaaccaatcctttctggaatcgctggttccgttcttcagaatcaggtgaagctctttgataagtttttcagtcaatgccgctttcgcattgtcgatgatcatgtcgatgcaccggaagtgatttgccgtttcaatcacatcatccacgttgaggacttcattttccacaccgatggtattggtctcaaaaatatatctcgtctgatcatgagtcaggcggctgccctcgatgtggtttgagttatatgtcaaatcaatctgagtcttatgataaattccgccagaatacttatttttcttctcattctgcaaaatatctaatagtgttatcggcttttcttctttcttattaatacgctccggcttttctgcattctctggaatattccaggtctttccggaaagaaacgctcccggcacacggccgtgggcgcagtaatttcttacactgcgctccgacacattccatttttccgctatctctatcactgaaagatattgcatctgatttcctccgttaattcacaatcaaaattatactaattttataaatagtatatcatattatcggcaataaattcaatgttctaattattaatcataatatttttgccgtttccggaaatattgcaaaaaggaaaactggactccacctcttaatagtgaaatccagttct
